United States Patent
Overgaard et al.

(10) Patent No.: US 10,385,399 B2
(45) Date of Patent: Aug. 20, 2019

(54) METHOD FOR DETERMINING CLINICALLY RELEVANT HYPOXIA IN CANCER

(75) Inventors: Jens Overgaard, Aarhus C (DK); Brita Singers Sorensen, Hjortshoj (DK); Jan Alsner, Hojbjerg (DK); Carsten Wiuf, Kobenhavn O (DK); Marianne Nordsmark, Risskov (DK); Kasper Toustrup, Hojbjerg (DK)

(73) Assignee: AARHUS UNIVERSITET, Aarhus (DK)

( * ) Notice: Subject to any disclaimer, the term of this patent is extended or adjusted under 35 U.S.C. 154(b) by 0 days.

(21) Appl. No.: 14/114,496

(22) PCT Filed: Apr. 30, 2012

(86) PCT No.: PCT/DK2012/050144
§ 371 (c)(1),
(2), (4) Date: Oct. 28, 2013

(87) PCT Pub. No.: WO2012/146259
PCT Pub. Date: Nov. 1, 2012

(65) Prior Publication Data
US 2015/0159218 A1 Jun. 11, 2015

(30) Foreign Application Priority Data
Apr. 29, 2011 (DK) .................. 2011 70212

(51) Int. Cl.
| | | |
|---|---|---|
| C12Q 1/6886 | (2018.01) | |
| A61K 31/5377 | (2006.01) | |
| A61K 45/06 | (2006.01) | |
| A61N 5/10 | (2006.01) | |
| G01N 33/49 | (2006.01) | |

(52) U.S. Cl.
CPC ........ *C12Q 1/6886* (2013.01); *A61K 31/5377* (2013.01); *A61K 45/06* (2013.01); *A61N 5/10* (2013.01); *G01N 33/4925* (2013.01); *A61N 2005/1098* (2013.01); *C12Q 2600/106* (2013.01); *C12Q 2600/112* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| | | | | |
|---|---|---|---|---|
| 2009/0275608 A1* | 11/2009 | Ossovskaya | ......... | C12Q 1/6886 514/307 |
| 2012/0329662 A1* | 12/2012 | West | ............. | C12Q 1/6809 506/7 |
| 2014/0045915 A1* | 2/2014 | Skog | ............. | C12Q 1/6806 514/44 A |

FOREIGN PATENT DOCUMENTS

| | | |
|---|---|---|
| EP | 2292587 | 3/2011 |
| JP | 2009011167 A | 1/2009 |
| JP | 2010-508022 | 3/2010 |
| WO | WO 2008/054726 | 5/2008 |
| WO | WO 2008/154927 A1 | 12/2008 |
| WO | WO 2009/112615 | 9/2009 |

OTHER PUBLICATIONS

Bristow, Robert G. and Hill, Richard P., "Hypoxia and metabolism: Hypoxia, DNA repair and genetic instability", Nature Reviews Cancer, vol. 8, No. 3, p. 180-192, Mar. 1, 2008.
Buffa, FM, et al., "Large meta-analysis of multiple cancers reveals a common, compact and highly prognostic hypoxia metagene", british Journal of Cancer, vol. 102, p. 428-435, 2010.
Chi, Jen-Tsan et al., "Gene Expression Programs in Response to Hypoxia: Cell Type Specificity and Prognostic Significance in Human Cancers", PLoS Medicine, vol. 3, Issue 3, p. 0395-0409, Mar. 2006.
Harrison, L.B. et al., "Impact of Tumor Hypoxia and Anemia on Radiation Therapy Outcomes", The Oncologist, Vo. 7, No. 6, p. 492-508, Dec. 1, 2002.
Keleg Shereen et al; Andrenomedullin is induced by hypoxia and enhanced pancreatic cancer cell invasion; International Journal of Cancer, John Wiley 6 Sons, Inc.; vil. 121, Jan. 1, 2007 pp. 21-32.
Moon, Eui Jung et al., "The Potential Role of Intrinsic Hypoxia Markers as Prognostic Variables in Cancer", Antioxidants & Redox Signaling, vol. 9, No. 8, 2007 pp. 1237-1294.
Overgaard, Jens, "Hypoxic modification of radiotherapy in squamous cell carcinoma of the head and neck—A systemic review and meta-analysis", Radiotherapy and Oncology, vol. 100, No. 1, p.22-32, Apr. 19, 2011.
Sørensen, Brita Singers et al., "Identifying pH independent hypoxia induced genes in human squamous cell carcinomas in vitro", Acta Oncologica, vol. 49, No. 7, p. 895-905, Oct. 2010.
Winter, Stuart C, et al., "Relation of a Hypoxia Metagene Derived from Head and Neck Cancer to Prognosis of Multiple Cancers", Cancer Res, vol. 67, 7, Apr. 1, 2007 (www.aacrjournals.org) pp. 3441-3449.

(Continued)

*Primary Examiner* — Channing S Mahatan
(74) *Attorney, Agent, or Firm* — Cooley LLP

(57) ABSTRACT

The present invention provides a method for determining the oxygen status of a cancer of an individual. The method comprise determining the transcriptional expression level of ADM (SEQ ID No:1), and/or at least one gene selected from ANKRD37 (SEQ ID NO.: 3), P4HA2 (SEQ ID NO.: 12), NDRG1 (SEQ ID NO: 10), SLC2A1 (SEQ ID NO:15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), and/or ALDOA (SEQ ID NO.: 2), in a cancer sample. The transcriptional level is then correlated to the transcriptional level to at least one reference gene, and oxygen status 10 is then evaluated by comparing the correlated transcription level with a predetermined reference sample comprising cancer cells characterized by a high oxygen level.

16 Claims, 4 Drawing Sheets
Specification includes a Sequence Listing.

(56) References Cited

OTHER PUBLICATIONS

Toustrup, K. et al; "Development of a Hypoxia Gene Expression Classifier with Predictive Impact for Hypoxic Modification of Radiotherapy in Head and Neck Cancer." Cancer Research (2011); 71.17: 5923-2931.

Aggerholm-Pedersen, Ninna et al; "A prognostic profile of hypoxia-induced genes for localised high-grade soft tissue sarcoma"; British Journal of Cancer, 2016, 15, 1096-1104 ; doi: 10.1038/bjc.2016.310.

Benita et al., "An integrative genomics approach identifies Hypoxia Inducible Factor-1 (HIF-1)-target genes that form the core response to hypoxia." Nucleic Acids Research (2009); 37(14): 4587-4602.

Sørensen et al., "Identifying pH independent hypoxia induced genes in human squamous cell carcinomas in vitro." Acta Oncologica (2010); 49(7): 895-905.

\* cited by examiner

METHOD FOR DETERMINING CLINICALLY RELEVANT HYPOXIA IN CANCER

FIELD OF INVENTION

The present invention relates to a method for determining the oxygen status of cancer, wherein the determination is based on transcriptional expression level of gene(s) differentially expressed in varying levels of oxygen. The invention also pertains to a method for treatment of cancer, pharmaceutical compositions and use of a medicament in the form of hypoxia-modifying agent, when the oxygen status is determined.

BACKGROUND OF INVENTION

Hypoxia is a frequent tumour characteristic associated to aggressive tumours and a reduced therapeutic response. In radiotherapy the reduced response is mainly due to hypoxia induced radio-resistance, which takes place, when there is a lack of oxygen to react with the free radicals released during irradiation thereby reducing the formation of damaging compounds inside the tumour. But hypoxia is also a clinical problem that can potentially be reduced by supplying the radiation therapy with hypoxia-modifying therapy. By adding a hypoxia-modifying agent for example a hypoxic sensitizer such as nitroimidazole to the treatment, reactive NO2-groups are supplied, that under anaerobic conditions can form damaging compounds similar to the oxygen-free radicals. Thus, by this additive action it is possible to improve the therapeutic response in the hypoxic tumours, which has also been verified in the DAHANCA 5 trial, where head and neck cancer patients treated with the hypoxic sensitizer nimorazole in conjunction with radiotherapy obtained an improved outcome compared to those treated with placebo. But not all tumours are hypoxic in a degree which justifies the use of hypoxia-modifying agents, since treatment including administration of hypoxia-modifying agents has side effects unpleasant to the diseased individual. One of the conclusions from the DAHANCA 5 trial was that there is a demand for better methods to detect tumour hypoxia, and thereby to help in the identification of those patients that will benefit from the hypoxia modifying therapy.

Well established approaches concerning the characterization of hypoxic tumour-status include the use of oxygen sensing electrodes, the infusion of exogenous hypoxic tracers (pimonidazole, 18F-miso, 18F-FAZA) or the quantification of endogenous markers related to the hypoxia-induced HIF-1α cascade (Moon et al., The potential role of intrinsic hypoxia markers as prognostic variables in cancer. Antioxid Redox Signal 9:1237-1294, 2007). These methods all contribute with important information, but are also coupled with disadvantages either in the form of mandatory invasive procedures or inadequate specificity concerning the association to hypoxia.

With cDNA microarray technology and gene expression profiling it has become possible to identify groups of genes (signatures, profiles, metagenes) characterized by being up- or down-regulated under certain relevant conditions. Also, signatures focusing on hypoxia have been developed. These signatures have increased our understanding of the microenvironment and hypoxia-regulated cell metabolism but they also carry the potential benefit of making us able to evaluate the hypoxic status of a tumour based on the expression of specific hypoxia responsive genes in the tumour biopsy. The clinical relevance of such "hypoxia gene expression signatures" has been described by more groups. In 2006, Chi et al suggested a range of 168 in vitro derived hypoxia responsive genes that also proved to be a strong predictor of clinical outcome in series of breast and ovarian cancers (Chi et al., Gene expression programs in response to hypoxia: Cell type specificity and prognostic significance in human cancers. PLoS Med 3:e47, 2006). Winter et al have developed a hypoxic signature, containing 99 genes, which proved to be an independent prognostic factor for recurrence free survival in a publically available head and neck cancer set and a significant prognostic factor for overall survival in a published breast cancer series. (Winter et al., Relation of a hypoxia metagene derived from head and neck cancer to prognosis of multiple cancers. Cancer Res 67:3441-3449, 2007). Based on in silico analysis of a core of genes from this signature, Buffa et al defined a "common hypoxia metagene" with even further prognostic impact (Buffa et al., Large meta-analysis of multiple cancers reveals a common, compact and highly prognostic hypoxia metagene. Br J Cancer 102:428-435, 2010). As stated with these studies, gene expression signatures focusing on hypoxia makes up a promising strategy concerning hypoxic classification and the prediction of outcome in more cancers.

But according to existing literature, no final hypoxic signature has yet been obtained and implemented as predictor of additive treatment with hypoxia modifying therapy in the clinical setting.

A developing strategy concerning this obstacle is to use the expression of hypoxia responsive genes in the tumour biopsy as an evaluation of the present oxygen status in the tumour and thereby to guide the treatment in according to this evaluation.

The present invention presents a method for determining the prognostic and predictive impact of the oxygen status of the tumour based on measuring the transcriptional levels of specific genes in the tumour, which are also correlated to hypoxia status.

SUMMARY OF INVENTION

In one aspect, the present invention relates to a method for determining the oxygen status of a cancer of an individual comprising
i) in a sample comprising cells of said cancer
ii) determining the transcriptional expression level of the ADM gene (SEQ ID NO:1) or a variant at least 95% identical thereto,
iii) correlating said transcriptional expression level of the ADM gene to the expression level of at least one reference gene, and
iv) evaluating the oxygen status of said cancer by comparing the correlated transcriptional expression level of iii) with a predetermined correlated transcriptional expression level of ADM.

In one preferred embodiment, the method comprises
i) in a sample comprising cells of said cancer
ii) determining the transcriptional expression level ADM and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes, iii) correlating said transcriptional expression level of the ADM gene and said at least one additional gene to the expression level of at least one reference gene, and iv) evaluating the oxygen status of said cancer by comparing the correlated transcriptional expression level of iii) with a predetermined correlated transcriptional expression level of ADM and said at least one additional gene.

In another aspect, the present invention provides a hypoxia-modifying agent for for use in the treatment of a cancer in an individual, wherein in said cancer i) the transcriptional expression level of ADM (SEQ ID NO:1) or a variant at least 95% identical thereto, ii) correlated to the expression of at least one reference gene, iii) corresponds to the correlated transcriptional expression level of ADM (SEQ ID NO: 1) or a variant at least 95% identical thereto of a predetermined reference sample comprising cancer cells characterized by a low oxygen level.

In yet another aspect, the invention relates to an electromagnetic radiation source for use in the treatment of cancer, wherein in said cancer i) the transcriptional expression level of ADM (SEQ ID NO:1) or a variant at least 95% identical thereto, ii) correlated to the expression of at least one reference gene, iii) corresponds to the correlated transcriptional expression level of ADM (SEQ ID NO: 1) or a variant at least 95% identical thereto of a predetermined reference sample comprising cancer cells characterized by a low oxygen level In a further aspect, the present invention pertains to a method for the amelioration and/or treatment of cancer in an individual comprising the steps of a. providing a sample of a cancer from said individual b. determining the oxygen status of said cancer by a method of the present invention, c. selecting an individual having a cancer characterized by low oxygen level d. administering a hypoxia-modifying agent in a therapeutically effective amount to said individuals.

The invention also in one aspect relates a method for the amelioration and/or treatment of cancer comprising the steps of i) providing a sample of a cancer from said individual b. determining the oxygen status of said cancer by a method of the present invention, iii) selecting individuals having a cancer characterized by high oxygen level, and iv) subjecting said individuals to radiation therapy without administering a hypoxia-modifying agent.

In another aspect, the present invention provides a method for selecting an individual having a cancer, which individual does not need treatment with a hypoxia modifying agent prior to or simultaneous with radiation therapy, said method comprising i) providing a sample of a cancer from said individual b. determining the oxygen status of said cancer by a method of the present invention, iii) selecting individuals having a cancer characterized by high oxygen status, and iv) subjecting said individuals having a cancer characterized by high oxygen status to radiation therapy without administering a hypoxia-modifying agent.

In another aspect, the present invention relates to a method for determining the oxygen status of a cancer of an individual comprising the steps of i) in a sample comprising cancer cells ii) determining the transcriptional expression level of at least one gene selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2), and variants of any one of said genes, iii) correlating said transcriptional expression level of the at least one gene of ii) to at least one reference gene, and iv) evaluating the oxygen status by comparing the correlated transcriptional expression level of iii) with the same correlated transcriptional expression level of the same one or more genes of ii) of a predetermined reference sample comprising cancer cells characterized by a high oxygen level and a predetermined reference sample comprising cancer cells characterized by a low oxygen level.

The oxygen status is preferably evaluated by calculating the difference (D) between the correlated transcriptional expression level of iii) with the same correlated transcriptional expression level of the same one or more genes of a predetermined reference sample having a high oxygen level and a predetermined reference sample having a low oxygen level, where $$D_i = \sum_m \frac{(y_m - z_{im})^2}{W_m}$$

wherein m refers to the $m^{th}$ gene out of the genes of ii), i is the 'low oxygen' or 'high oxygen' reference sample, z is the mean expression level of the reference sample, W is the calculated common variance and y is the transcriptional gene expression of the sample comprising cancer cells, wherein the sample of i) has a high oxygen level if the distance (D) between the sample comprising cancer cells and the high oxygen reference sample is smaller than the distance (D) between the sample comprising cancer cells and the low oxygen reference sample, and wherein the sample of i) has a low oxygen level if the distance (D) between the sample comprising cancer cells and the low oxygen reference sample is smaller than the distance (D) between the sample comprising cancer cells and the high oxygen reference sample.

The transcriptional expression level of ii) is preferably determined by quantitative PCR (qPCR).

Preferably, the transcriptional expression level of the at least one gene of ii) is correlated to said at least one reference gene by subtracting the geometric mean of the cycle threshold (Ct) values of each of the at least one, such as three, reference genes from the Ct value of the at least one gene of ii) giving ΔCt, transforming the expression value of the gene of ii) to fold difference relative to said reference genes by calculating $2^{-\Delta ct}$, and log 2-transforming the fold difference giving the gene expression value (y), wherein the Ct value is defined as the number of cycles required for a qPCR fluorescent signal to cross a threshold chosen on the basis of the baseline variability. In a most preferred embodiment, the at least one gene of ii) is correlated to one or more reference genes selected from ACTR3, NDFIP1, and 7 or RPL37A. In a more preferred embodiment, the at least one gene is correlated to the expression of ACTR3, NDFIP1 and RPL37A by subtracting the geometric mean of the cycle threshold (Ct) values of each of ACTR3, NDFIP1 and RPL37A.

The sample is in one embodiment formalin fixated.

The cancer cells are for example hypoxic cells.

The cancer cells of the present invention are in one embodiment planocellular cancer cells, squamous cellular cancer cells, and/or may be selected from the group consisting of squamous cellular cancers of the head and neck, skin, esophagus, urinary bladder, prostate, lungs, vagina, and cervix. Non-limiting examples are squamous cell carcinoma, and squamous cellular cancer such as head and neck cancer, and the head and neck cancer is for example selected from the group consisting of cancer of the mouth, lips, cancer of the nasal cavity and nasopharyngeal cancer.

In the method of the invention, the transcriptional expression level is determined for at least 2, preferably at least 3, more preferably at least 4, even more preferably at least 5 genes selected from the group consisting of ADM (SEQ ID No:1), ALDOA (SEQ ID NO.: 2), ANKRD37 (SEQ ID NO.: 3), BNIP3 (SEQ ID NO.:4), BNIP3L (SEQ ID NO.: 5), C3orf28 (SEQ ID NO.: 6), EGLN3 (SEQ ID NO.: 7), KCTD11 (SEQ ID NO.: 8), LOX (SEQ ID NO.: 9), NDRG1 (SEQ ID NO: 10), P4HA1 (SEQ ID NO.: 11), P4HA2 (SEQ ID NO.: 12), PDK1 (SEQ ID NO.: 13), PFKFB3 (SEQ ID NO.: 14) AND SLC2A1 (SEQ ID NO: 15), and variants thereof is determined in step ii).

In another embodiment of the method of the invention, the transcriptional expression level is determined for at least 6, preferably at least 7, more preferably at least 8, even more preferably at least 9, preferably at least 10, more preferably at least 11, even more preferably at least 11, preferably at least 12, more preferably at least 13, even more preferably at least 14, preferably at least 15 genes selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2), and variants thereof is determined in step ii).

In a most preferred embodiment, the transcriptional expression level is determined for the 15 genes ADM, ALDOA, ANKRD37, BNIP3, BNIP3L, C3orf28, EGLN3, KCTD11, LOX, NDRG1, P4HA1, P4HA2, PDK1, PFKFB3 and SLC2A1.

In another aspect, the present invention pertains to a method for determining the prognosis of a cancer of an individual, wherein the oxygen status of the cancer is determined by a method as defined herein above; i.e. a method for determining the oxygen status of a cancer of an individual comprising
i) in a sample comprising cells of said cancer
ii) determining the transcriptional expression level of the ADM gene (SEQ ID NO:1) or a variant at least 95% identical thereto,
iii) correlating said transcriptional expression level of the ADM gene to the expression level of at least one reference gene, and
iv) evaluating the oxygen status of said cancer by comparing the correlated transcriptional expression level of iii) with a predetermined correlated transcriptional expression level of ADM.

In one preferred embodiment, the method comprises
i) in a sample comprising cells of said cancer
ii) determining the transcriptional expression level ADM and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes,
iii) correlating said transcriptional expression level of the ADM gene and said at least one additional gene to the expression level of at least one reference gene, and
iv) evaluating the oxygen status of said cancer by comparing the correlated transcriptional expression level of iii) with a predetermined correlated transcriptional expression level of ADM and said at least one additional gene.

In the prognostic method of the invention, a cancer having low oxygen status is associated with a poor prognosis.

In another aspect, the present invention relates to a method for the amelioration and/or treatment of cancer comprising the steps of
i) obtaining a sample of a cancer from an individual
ii) determining the oxygen status of said cancer by a method of the present invention,
iii) selecting individuals having a cancer characterized by low oxygen level
iv) administering a hypoxia-modifying agent in a therapeutically effective amount in said individuals, The cancer is preferably characterized by low oxygen level.

Without limitation, the hypoxia-modifying agent is for example selected from the group consisting of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidin kinase inhibitors, CA4O OXi4503, DMXAA, nimorazole, MISO and DORA.

For example, the hypoxia-modifying agent is selected from the group consisting of as nimorazole, misonidazole and doranidazole, or the hypoxia-modifying agent is nimorazole (4-[2-(5-nitro-1H-imidazol-1-yl)ethyl]morpholine).

According to the method of the present invention, a further step may be added of administering an additional compound, such as one or more anti-proliferative and/or anti-neoplastic agents, and/or a radiosensitizing drug.

In another aspect, the present invention relates to a method for amelioration and/or treatment of cancer comprising the steps of
i) obtaining a sample of a cancer from said individual
ii) determining the oxygen status of said cancer by a method of the present invention,
iii) selecting individuals having a cancer characterized by high oxygen level, and
iv) subjecting said individuals to radiation therapy without administering a hypoxia-modifying agent.

The cancer is then, preferably characterized by high oxygen level.

In a further aspect, the present invention relates to a pharmaceutical composition comprising a hypoxia-modifying agent or a pharmaceutically acceptable salt thereof for treatment of cancer. The cancer is then preferably characterised by low oxygen level. The hypoxia-modifying agent is for example selected from the group consisting of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidin kinase inhibitors, CA4O OXi4503, DMXAA, nimorazole, MISO and DORA. In another example, the hypoxia-modifying agent is selected from the group consisting of as nimorazole, misonidazole and doranidazole, and in yet another embodiment, the hypoxia-modifying agent is Nimorazole is (4-[2-(5-nitro-1H-imidazol-1-yl)ethyl]morpholine).

In another aspect, the invention relates to the use of a hypoxia-modifying agent for the manufacture of a medicament for treatment of cancer. The cancer is preferably characterized by low oxygen level.

In the methods, pharmaceutical compositions, and uses of the present invention, the oxygen level of a cancer sample is determined by a method of the present invention, such as generally defined by claim 1. Also for the methods, pharmaceutical compositions, and uses of the invention, the cancer is in one example a planocellular cancer, a squamous cellular cancer, such as is selected from the group consisting of squamous cellular cancers of the head and neck, skin, esophagus, urinary bladder, prostate, lungs, vagina, and cervix. In a particular example, the squamous cellular cancer is squamous cell carcinoma, or the squamous cellular cancer is head and neck cancer. The head and neck cancer is selected from the group consisting of cancer of the mouth, lips, cancer of the nasal cavity and nasopharyngeal cancer.

DETAILED DESCRIPTION OF THE INVENTION

Definitions

Figure 1:
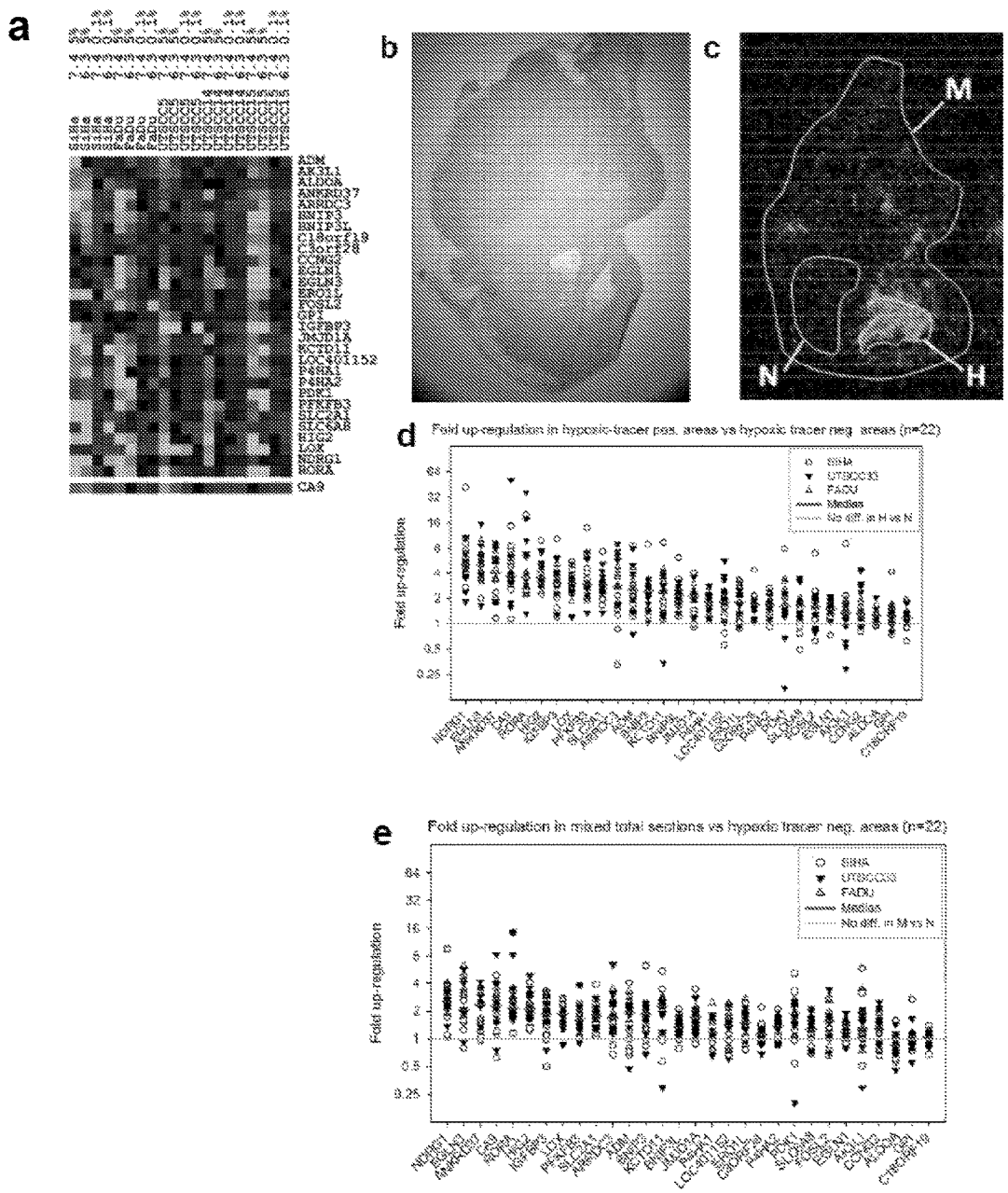
FIG. 1. Identifying and validating hypoxia responsive and pH independent genes. a. In vitro derived genes characterized by hypoxia induced upregulation and insensitivity to pH-fluctuations (except CA9). b-c. H.E. and autoradiografic presentation of hypoxia tracer 18F FAZA distribution in xenograft tumour, (H) tracer-positive area resembling hypoxic tumour tissue, (N) tracer-negative area resembling non-hypoxic tumour tissue, (M) total section resembling a heterogeneous mix of hypoxic and non-hypoxic tumours tissue. d. Fold upregulation in hypoxic tumour area (H) compared to non-hypoxic tumour area (N). e. Fold upregulation in total heterogeneous tumour section (M) compared to non-hypoxic tumour tissue (N).

The term 'individual' and 'individual in need thereof' as used herein refers to a male or female mammal, preferably a human being at any age which is suspected of having cancer, such as planocellular cancer and/or squamous cellular cancer, or has contracted cancer.

The terms 'therapeutically effective amount' means an amount that is sufficient to elicit a desired response.

The term 'gene' as used herein refers to its normal meaning, a nucleic acid sequence with a transcriptional capability, i.e., which can be transcribed into an RNA sequence (an expressed sequence) which in most cases, is translated into an amino acid sequence, along with the regulatory sequences that regulate expression or engage in the expression of expressed sequences.

A double stranded polynucleotide contains two strands that are complementary in sequence and capable of hybridizing to one another.

A nucleotide is herein defined as a monomer of RNA or DNA. A nucleotide is a ribose or a deoxyribose ring attached to both a base and a phosphate group. Both mono-, di-, and tri-phosphate nucleosides are referred to as nucleotides.

The term 'nucleotides' as used herein refers to both natural nucleotides and non-natural nucleotides capable of being incorporated—in a template-directed manner—into an oligonucleotide, preferably by means of an enzyme comprising DNA or RNA dependent DNA or RNA polymerase activity, including variants and functional equivalents of natural or recombinant DNA or RNA polymerases. Corresponding binding partners in the form of coding elements and complementing elements comprising a nucleotide part are capable of interacting with each other by means of hydrogen bonds. The interaction is generally termed "base-pairing". Nucleotides may differ from natural nucleotides by having a different phosphate moiety, sugar moiety and/or base moiety. Nucleotides may accordingly be bound to their respective neighbour(s) in a template or a complementing template by a natural bond in the form of a phosphodiester bond, or in the form of a non-natural bond, such as e.g. a peptide bond as in the case of PNA (peptide nucleic acids). Nucleotides according to the invention includes ribonucleotides comprising a nucleobase selected from the group consisting of adenine (A), uracil (U), guanine (G), and cytosine (C), and deoxyribonucleotide comprising a nucleobase selected from the group consisting of adenine (A), thymine (T), guanine (G), and cytosine (C). Nucleobases are capable of associating specifically with one or more other nucleobases via hydrogen bonds. Thus it is an important feature of a nucleobase that it can only form stable hydrogen bonds with one or a few other nucleobases, but that it can not form stable hydrogen bonds with most other nucleobases usually including itself. The specific interaction of one nucleobase with another nucleobase is generally termed "base-pairing". The base pairing results in a specific hybridisation between predetermined and complementary nucleotides. Complementary nucleotides according to the present invention are nucleotides that comprise nucleobases that are capable of base-pairing. Of the naturally occurring nucleobases adenine (A) pairs with thymine (T) or uracil (U); and guanine (G) pairs with cytosine (C). Accordingly, e.g. a nucleotide comprising A is complementary to a nucleotide comprising either T or U, and a nucleotide comprising G is complementary to a nucleotide comprising C.

The term 'oligonucleotide' is used herein interchangebly with polynucleotide. As used herein the term "oligonucleotide" refers to a single stranded or double stranded oligomer or polymer of ribonucleic acid (RNA) or deoxyribonucleic acid (DNA) or mimetics thereof. This term includes oligonucleotides composed of naturally-occurring bases, sugars and covalent internucleoside linkages (e.g., backbone) as well as oligonucleotides having non-naturally-occurring portions which function similarly to respective naturally-occurring portions. The term oligonucleotide thus also refers to any combination of oligonucleotides of natural and non-natural nucleotides. The natural and/or non-natural nucleotides may be linked by natural phosphodiester bonds or by non-natural bonds. Preferred oligonucleotides comprise only natural nucleotides linked by phosphodiester bonds. Oligonucleotide is used interchangeably with polynucleotide. The oligomer or polymer sequences of the present invention are formed from the chemical or enzymatic addition of monomer subunits. The term "oligonucleotide" as used herein includes linear oligomers of natural or modified monomers or linkages, including deoxyribonucleotides, ribonucleotides, anomeric forms thereof, peptide nucleic acid monomers (PNAs), locked nucleotide acid monomers (LNA), and the like, capable of specifically binding to a single stranded polynucleotide tag by way of a regular pattern of monomer-to-monomer interactions, such as Watson-Crick type of base pairing, base stacking, Hoogsteen or reverse Hoogsteen types of base pairing, or the like. Usually monomers are linked by phosphodiester bonds or analogs thereof to form oligonucleotides ranging in size from a few monomeric units, e.g. 3-4, to several tens of monomeric units, e.g. 40-60. Whenever an oligonucleotide is represented by a sequence of letters, such as "ATGC-CTG," it will be understood that the nucleotides are in 5'→3' order from left to right and the "A" denotes deoxyadenosine, "C" denotes deoxycytidine, "G" denotes deoxyguanosine, and "T" denotes thymidine, unless otherwise noted. Usually oligonucleotides of the invention comprise the four natural nucleotides; however, they may also comprise methylated or non-natural nucleotide analogs. In addition to the 100% complementary form of double-stranded oligonucleotides, the term "double-stranded" as used herein is also meant to refer to those forms which include such structural features as bulges and loops.

A plurality of individual nucleotides linked together in a single molecule may form a polynucleotide. Polynucleotide covers any derivatized nucleotides such as DNA, RNA, PNA, LNA etc. Any oligonucleotide is also a polynucleotide, but every polynucleotide is not an oligonucleotide.

Method for Determining Oxygen Status

The present invention relates to a method for classifying malignant tumours into more or less hypoxic subtypes. The classification of cancers into such two groups can be of either prognostic or predictive importance when determining which individuals who will benefit from specific treatment regimes. These specific treatment regimes can either be in the form of intensified conventional therapy, additive hypoxic modification or treatment with reactive hypoxic cytotoxins.

Typically, hypoxia occurs in solid tumours due to insufficient vascularisation, rapid cell proliferation and increased metabolism in the tumour cells. Tumours in which the oxygen levels is below 20 mmHg is generally considered as being hypoxic but tumours with oxygen levels in the range of 2.5 to 5 mmHg are furthermore often resistant to radiotherapy. The resistance involves a lack of oxygen to react with free radicals released during irradiation thereby reducing the formation of damaging compounds inside the tumour. Consequently, treatment of individuals suffering from cancer, wherein the oxygen level is classified as low ('more' hypoxic) with hypoxia-modifying agents, hypoxic cytotoxins alone or in combination with radiation will improve the therapeutic outcome.

Thus, in one aspect, the present invention relates to a method for determining the oxygen status of a cancer of an individual comprising
  i) in a sample comprising cells of said cancer
  ii) determining the transcriptional expression level of the ADM gene (SEQ ID NO:1) or a variant at least 95% identical thereto,
  iii) correlating said transcriptional expression level of the ADM gene to the expression level of at least one reference gene, and
  iv) evaluating the oxygen status of said cancer by comparing the correlated transcriptional expression level of iii) with a predetermined correlated transcriptional expression level of ADM.

In a preferred embodiment, the method comprises
  i) in a sample comprising cells of said cancer
  ii) determining the transcriptional expression level ADM and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes,
  iii) correlating said transcriptional expression level of the ADM gene and said at least one additional gene to the expression level of at least one reference gene, and
  iv) evaluating the oxygen status of said cancer by comparing the correlated transcriptional expression level of iii) with a predetermined correlated transcriptional expression level of ADM and said at least one additional gene.

In one aspect the present invention relates to a method for determining the oxygen status of a cancer of an individual comprising the steps of
  i) in a sample comprising cancer cells
  ii) determining the transcriptional expression level of at least one gene selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2), and variants of any one of said genes, iii) correlating said transcriptional expression level of the at least one gene of ii) to at least one reference gene, and iv) evaluating the oxygen status by comparing the correlated transcriptional expression level of iii) with the same correlated transcriptional expression level of the same one or more genes of ii) of a predetermined reference sample comprising cancer cells characterized by a high oxygen level and a predetermined reference sample comprising cancer cells characterized by a low oxygen level.

The oxygen status is preferably evaluated by calculating the difference (D) between the correlated transcriptional expression level of iii) with the same correlated transcriptional expression level of the same one or more genes of a predetermined reference sample having a high oxygen level and a predetermined reference sample having a low oxygen level, where $$D_i = \sum_m \frac{(y_m - z_{im})^2}{W_m}$$

wherein m refers to the $m^{th}$ gene out of the genes of ii), i is the 'low oxygen' or 'high oxygen' reference sample, z is the mean expression level of the reference sample, W is the calculated common variance and y is the transcriptional gene expression of the sample comprising cancer cells, wherein the sample of i) has a high oxygen level if the distance (D) between the sample comprising cancer cells and the high oxygen reference sample is smaller than the distance (D) between the sample comprising cancer cells and the low oxygen reference sample, and wherein the sample of i) has a low oxygen level if the distance (D) between the sample comprising cancer cells and the low oxygen reference sample is smaller than the distance (D) between the sample comprising cancer cells and the high oxygen reference sample.

Preferably, the transcriptional expression level of the at least one gene of ii) is correlated to said at least one reference gene by subtracting the geometric mean of the cycle threshold (Ct) values of each of the at least one, such as three, reference genes from the Ct value of the at least one gene of ii) giving ΔCt, transforming the expression value of the gene of ii) to fold difference relative to said reference genes by calculating $2^{-\Delta ct}$, and log 2-transforming the fold difference giving the gene expression value (y), wherein the Ct value is defined as the number of cycles required for a qPCR fluorescent signal to cross a threshold chosen on the basis of the baseline variability. In a most preferred embodiment, the at least one gene of ii) is correlated to one or more reference genes selected from ACTR3, NDFIP1, and/or RPL37A. In a more preferred embodiment, the at least one gene is correlated to the expression of ACTR3, NDFIP1 and RPL37A by subtracting the geometric mean of the cycle threshold (Ct) values of each of ACTR3, NDFIP1 and RPL37A.

In the method of the invention, the transcriptional expression level is determined for at least 2, preferably at least 3, more preferably at least 4, even more preferably at least 5 genes selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2), and variants thereof is determined in step ii).

In a most preferred embodiment, the transcriptional expression level is determined for ADM, ANKRD37, P4HA2, NDRG1, SLC2A1, P4HA1, LOX, C3orf28, BNIP3L, BNIP3, EGLN3, PDK1, PFKFB3, KCTD11 and ALDOA.

In another embodiment the transcriptional level is determined of at at least 6 genes, for example 7 genes, such as 8 genes, for example 9 genes, such as 10 genes, for example 11 genes, such as 12 genes, for example 13 genes, such as 14 genes, for example 15 genes selected from ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2).

In one embodiment of the present invention the transcriptional expression level is determined of at least one gene selected from the group consisting of ADM, ANKRD37, P4HA2, NDRG1, SLC2A1, P4HA1, LOX, C3orf28, BNIP3L, BNIP3, EGLN3, PDK1, PFKFB3, KCTD11 and ALDOA.

For example in one embodiment of the present invention the transcriptional expression level is determined for ADM and at least one gene selected from ANKRD37, P4HA2, NDRG1, SLC2A1, P4HA1, LOX, C3orf28, BNIP3L, BNIP3, EGLN3, PDK1, PFKFB3, KCTD11 and ALDOA.

Analogously, in one embodiment of the present invention the transcriptional expression level is determined for ANKRD37 and at least one gene selected from ADM and at least one gene selected from ANKRD37, P4HA2, NDRG1, SLC2A1, P4HA1, LOX, C3orf28, BNIP3L, BNIP3, EGLN3, PDK1, PFKFB3, KCTD11 and ALDOA.

Similarly, in one embodiment of the present invention the transcriptional expression level is determined for P4HA2 and at least one gene selected from ADM, ANKRD37, NDRG1, SLC2A1, P4HA1, LOX, C3orf28, BNIP3L, BNIP3, EGLN3, PDK1, PFKFB3, KCTD11 and ALDOA.

Furthermore, in one embodiment of the present invention the transcriptional expression level is determined for NDRG1 and at least one gene selected from ADM, ANKRD37, P4HA2, SLC2A1, P4HA1, LOX, C3orf28, BNIP3L, BNIP3, EGLN3, PDK1, PFKFB3, KCTD11 and ALDOA.

Furthermore, in one embodiment of the present invention the transcriptional expression level is determined for SLC2A1 and at least one gene selected from ADM, ANKRD37, P4HA2, NDRG1, P4HA1, LOX, C3orf28, BNIP3L, BNIP3, EGLN3, PDK1, PFKFB3, KCTD11 and ALDOA.

Furthermore, in one embodiment of the present invention the transcriptional expression level is determined for P4HA1 and at least one gene selected from ADM, ANKRD37, P4HA2, NDRG1, SLC2A1, LOX, C3orf28, BNIP3L, BNIP3, EGLN3, PDK1, PFKFB3, KCTD11 and ALDOA.

Furthermore, in one embodiment of the present invention the transcriptional expression level is determined for LOX and at least one gene selected from ADM, ANKRD37, P4HA2, NDRG1, SLC2A1, P4HA1, C3orf28, BNIP3L, BNIP3, EGLN3, PDK1, PFKFB3, KCTD11 and ALDOA.

Furthermore, in one embodiment of the present invention the transcriptional expression level is determined for C3orf28 and at least one gene selected from ADM, ANKRD37, P4HA2, NDRG1, SLC2A1, P4HA1, LOX, BNIP3L, BNIP3, EGLN3, PDK1, PFKFB3, KCTD11 and ALDOA.

Furthermore, in one embodiment of the present invention the transcriptional expression level is determined for BNIP3L and at least one gene selected from ADM, ANKRD37, P4HA2, NDRG1, SLC2A1, P4HA1, LOX, C3orf28, BNIP3, EGLN3, PDK1, PFKFB3, KCTD11 and ALDOA.

Furthermore, in one embodiment of the present invention the transcriptional expression level is determined for BNIP3 and at least one gene selected from ADM, ANKRD37, P4HA2, NDRG1, SLC2A1, P4HA1, LOX, C3orf28, BNIP3L, EGLN3, PDK1, PFKFB3, KCTD11 and ALDOA.

Moreover, in one embodiment of the present invention the transcriptional expression level is determined for EGLN3 and at least one gene selected from ADM, ANKRD37, P4HA2, NDRG1, SLC2A1, P4HA1, LOX, C3orf28, BNIP3L, BNIP3, PDK1, PFKFB3, KCTD11 and ALDOA.

Furthermore, in one embodiment of the present invention the transcriptional expression level is determined for PDK1 and at least one gene selected from ADM, ANKRD37, P4HA2, NDRG1, SLC2A1, P4HA1, LOX, C3orf28, BNIP3L, BNIP3, EGLN3, PFKFB3, KCTD11 and ALDOA.

Furthermore, in one embodiment of the present invention the transcriptional expression level is determined for PFKFB3 and at least one gene selected from ADM, ANKRD37, P4HA2, NDRG1, SLC2A1, P4HA1, LOX, C3orf28, BNIP3L, BNIP3, EGLN3, PDK1, KCTD11 and ALDOA.

Moreover, in one embodiment of the present invention the transcriptional expression level is determined for KCTD11 and at least one gene selected from ADM, ANKRD37, P4HA2, NDRG1, SLC2A1, P4HA1, LOX, C3orf28, BNIP3L, BNIP3, EGLN3, PDK1, PFKFB3 and ALDOA.

Furthermore, in one embodiment of the present invention the transcriptional expression level is determined for ALDOA and at least one gene selected from ADM, ANKRD37, P4HA2, NDRG1, SLC2A1, P4HA1, LOX, C3orf28, BNIP3L, BNIP3, EGLN3, PDK1, PFKFB3 and KCTD11.

In one specific embodiment of the present method, the transcriptional expression level is determined for at least ADM gene. In another specific embodiment, the transcriptional expression level is determined for at least ADM and ANKRD37. In another specific embodiment, the transcriptional expression level is determined for at least ADM, ANKRD37 and P4HA2. In another specific embodiment, the transcriptional expression level is determined for at least ADM, ANKRD37, P4HA2 and NDRG1. In another specific embodiment, the transcriptional expression level is determined for at least ADM, ANKRD37, P4HA2, NDRG1 and SLC2A1. In another specific embodiment, the transcriptional expression level is determined for at least ADM, ANKRD37, P4HA2, NDRG1, SLC2A1 and P4HA1. In another specific embodiment, the transcriptional expression level is determined for at least ADM, ANKRD37, P4HA2, NDRG1, SLC2A1, P4HA1 and LOX. In another specific embodiment, the transcriptional expression level is determined for at least ADM, ANKRD37, P4HA2, NDRG1, SLC2A1, P4HA1, LOX and C3orf28. In another specific embodiment, the transcriptional expression level is determined for at least ADM, ANKRD37, P4HA2, NDRG1, SLC2A1, P4HA1, LOX, C3orf28 and BNIP3L. In another specific embodiment, the transcriptional expression level is determined for at least ADM, ANKRD37, P4HA2, NDRG1, SLC2A1, P4HA1, LOX, C3orf28, BNIP3L and BNIP3. In another specific embodiment, the transcriptional expression level is determined for at least ADM, ANKRD37, P4HA2, NDRG1, SLC2A1, P4HA1, LOX, C3orf28, BNIP3L, BNIP3 and EGLN3. In another specific embodiment, the transcriptional expression level is determined for at least ADM, ANKRD37, P4HA2, NDRG1, SLC2A1, P4HA1, LOX, C3orf28, BNIP3L, BNIP3, EGLN3 and PDK1. In another specific embodiment, the transcriptional expression level is determined for at least ADM, ANKRD37, P4HA2, NDRG1, SLC2A1, P4HA1, LOX, C3orf28, BNIP3L, BNIP3, EGLN3, PDK1 and PFKFB3. In another specific embodiment, the transcriptional expression level is determined for at least ADM, ANKRD37, P4HA2, NDRG1, SLC2A1, P4HA1, LOX, C3orf28, BNIP3L, BNIP3, EGLN3, PDK1, PFKFB3 and KCTD11.

In another specific embodiment, the transcriptional expression level is determined for at least ANKRD37, P4HA2, NDRG1, SLC2A1 and P4HA1. In another specific embodiment, the transcriptional expression level is determined for at least ADM, P4HA2 and NDRG1. In another specific embodiment, the transcriptional expression level is determined for at least ADM, ANKRD37, NDRG1, SLC2A1, P4HA1 and LOX.

In another specific embodiment, the transcriptional expression level is determined for at least P4HA2, NDRG1, P4HA1, LOX, C3orf28, and BNIP3L. In another specific embodiment, the transcriptional expression level is determined for at least ADM, ANKRD37, P4HA2, NDRG1 and SLC2A1. In another specific embodiment, the transcriptional expression level is determined for at least NDRG1, SLC2A1, P4HA1, LOX, C3orf28, BNIP3L and BNIP3 In another specific embodiment, the transcriptional expression level is determined for at least ADM, ANKRD37, NDRG1, SLC2A1 and P4HA1. In another specific embodiment, the transcriptional expression level is determined for at least ADM, ANKRD37, P4HA1, and LOX. In another specific embodiment, the transcriptional expression level is determined for at least ANKRD37, NDRG1, SLC2A1, P4HA1 and LOX.

However, the genes of the present may in another embodiment may be complementary to a polynucleotide comprising a nucleic acid having at least 85%, such as 90%, such as at least 91, 92, 93, 94, or at least 95% identity, such as at least 96%, 97%, 98%, or 99% identity to the gene in question, selected from SEQ ID NO.: 1, 2, 3, 4, 5, 6, 7, 8 9, 10, 11, 12, 13, 14 or 15.

The genes of the present invention may comprise the nucleotide sequence of a naturally occurring allelic nucleic acid variant.

The nucleic acid sequence of the genes of the invention may differ by a single nucleotide from a nucleic acid sequence selected from the group consisting of SEQ ID NO.: 1, 2, 3, 4, 5, 6, 7, 8 9, 10, 11, 12, 13, 14 and 15. However, the nucleic acid sequence of the gene may also differ from a nucleic acid sequence selected from the group consisting of SEQ ID NO.: 1, 2, 3, 4, 5, 6, 7, 8 9, 10, 11, 12, 13, 14 or 15 by 2, 3, 4, 5, 6, 7, 8, 9, 10, or more nucleotides.

The following terms are used to describe the sequence relationships between two or more polynucleotides: "predetermined sequence", "comparison window", "sequence identity", "percentage of sequence identity", and "substantial identity".

A "predetermined sequence" is a defined sequence used as a basis for a sequence comparison; a predetermined sequence may be a subset of a larger sequence, for example, as a segment of a full-length DNA, transcriptional product thereof, gene sequence given in a sequence listing, such as a polynucleotide sequence of SEQ ID NO:1 to 15 or may comprise a complete DNA or gene sequence. Generally, a predetermined sequence is at least 20 nucleotides in length, frequently at least 25 nucleotides in length, and often at least 50 nucleotides in length.

Since two polynucleotides may each (1) comprise a sequence (i.e., a portion of the complete polynucleotide sequence) that is similar between the two polynucleotides, and (2) may further comprise a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window", as used herein, refers to a conceptual segment of at least 20 contiguous nucleotide positions wherein a polynucleotide sequence may be compared to a predetermined sequence of at least 20 contiguous nucleotides and wherein the portion of the polynucleotide sequence in the comparison window may comprise additions or deletions (i.e., gaps) of 20 percent or less as compared to the predetermined sequence (which does not comprise additions or deletions) for optimal alignment of the two sequences.

Optimal alignment of sequences for aligning a comparison window may be conducted by the local homology algorithm of Smith and Waterman (1981) Adv. Appl. Math. 2: 482, by the homology alignment algorithm of Needleman and Wunsch (1970) J. Mol. Biol. 48: 443, by the search for similarity method of Pearson and Lipman (1988) Proc. Natl. Acad. Sci. (U.S.A.) 85: 2444, by computerized implementations of these algorithms (GAP, BESTFIT, FASTA, and TFASTA in the Wisconsin Genetics Software Package Release 7.0, Genetics Computer Group, 575 Science Dr., Madison, Wis.), or by inspection, and the best alignment (i.e., resulting in the highest percentage of homology over the comparison window) generated by the various methods is selected.

The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity. The terms "substantial identity" as used herein denotes a characteristic of a polynucleotide sequence, wherein the polynucleotide comprises a sequence that has at least 85 percent sequence identity, preferably at least 90 to 95 percent sequence identity, more usually at least 99 percent sequence identity as compared to a predetermined sequence over a comparison window of at least 20 nucleotide positions, frequently over a window of at least 25-50 nucleotides, wherein the percentage of sequence identity is calculated by comparing the predetermined sequence to the polynucleotide sequence which may include deletions or additions which total 20 percent or less of the predetermined sequence over the window of comparison. The predetermined sequence may be a subset of a larger sequence, for example, as a segment of the full-length SEQ ID NO:1 to 15 polynucleotide sequence disclosed herein.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to a nucleotide sequence selected from the group consisting SEQ ID NO.: 1, 2, 3, 4, 5, 6, 7, 8 9, 10, 11, 12, 13, 14 and 15.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 1.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 2.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 3.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 4.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 5.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 6.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 7.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 8.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 9.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 10.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 11.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 12.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 13.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 14.

In one embodiment, the nucleic acid sequence of the gene(s) of the present invention has at least 95% sequence identity, more preferably e.g. at least 96% sequence identity, more preferably such as at least 97% sequence identity, more preferably e.g. at least 98% sequence identity, more preferably such as at least 99% sequence identity, more preferably e.g. at least 99.5% sequence identity to the nucleotide sequence presented as SEQ ID NO.: 15.

It is appreciated that the complementary sequences to those identified by the SEQ ID NOs of the present invention are also useful in the present invention and thus are encompassed within the scope of the present invention. Complementary or partly complementary refers to the hybridization or base pairing between nucleotides or nucleic acids, such as, for instance, between two strands of a double stranded DNA molecule, between two strands of a RNA-DNA duplex or between an oligonucleotide primer and a primer binding site on a single stranded nucleic acid to be sequenced, amplified or reversely transcribed according to the present invention. Complementary nucleotides are, generally, A and T (or A and U), or C and G. Two single stranded RNA or DNA molecules are said to be substantially complementary when the nucleotides of one strand, optimally aligned and with appropriate nucleotide insertions or deletions, pair with at least about 80% of the nucleotides of the other strand, usually at least about 90% to 95%, and more preferably from about 98 to 100%.

Alternatively, substantial complementarity exists when an RNA or DNA strand will hybridize under selective hybridization conditions to its complement. Selective hybridization conditions include, but are not limited to, stringent hybridization conditions. Selective hybridization occurs in one embodiment when there is at least about 65% complementarity over a stretch of at least 14 to 25 nucleotides, preferably at least about 75%, more preferably at least about 90% complementarity. See, M. Kanehisa (Nucleic Acids Res. 12, 203, 1984), incorporated herein by reference. For shorter nucleotide sequences selective hybridization occurs when there is at least about 65% complementarity over a stretch of at least 8 to 12 nucleotides, preferably at least about 75%, more preferably at least about 90% complementarity. Stringent hybridization conditions will typically include salt concentrations of less than about 1 M, more usually less than about 500 mM and preferably less than about 200 mM. Hybridization temperatures can be as low as 5° C. and are preferably lower than about 30° C. However, longer fragments may require higher hybridization temperatures for specific hybridization. Hybridization temperatures are generally about 2° C. to 6° C. lower than melting temperatures ($T_m$), which for polynucleotides comprising less than about 20 nucleotides can be calculated as $$T_m = 4 \times (G+C \text{ content}) + 2 \times (A+T \text{ content}).$$

As other factors may affect the stringency of hybridization, including base composition and length of the complementary strands, presence of organic solvents and extent of base mismatching, the combination of parameters is more important than the absolute measure of any one alone.

Encompassed by the present invention are transcripts of the genes or variants thereof that are able to hybridise to the oligonucleotide probes according to table 1.

TABLE 1

Hypoxia assays:

| Gene name | ABI assay number | RefSeq | Exon boundary | Assay location | Amplicon length |
|---|---|---|---|---|---|
| NDRG1 | Hs00608389 | NM_001135242.1 | 13-14 | 1447 | 69 |
| PFKFB3 | Hs00998700 | NM_001145443.1 | 13-14 | 1399 | 60 |
| SLC2A1 | Cf. Sequence | NM_006516.2 | 2-3 | | |

TABLE 1-continued

Hypoxia assays:

| Gene name | ABI assay number | RefSeq | Exon boundary | Assay location | Amplicon length |
|---|---|---|---|---|---|
| | below | | | | |
| BNIP3L | Hs00188949 | NM_004331.2 | 2-3 | 412 | 69 |
| P4HA1 | Hs00914594 | NM_001017962.2 | 14-15 | 1776 | 99 |
| LOX | Hs00184700 | NM_002317.4 | 2-3 | 1118 | 69 |
| C3orf28 | Hs01055823 | NM_014367.3 | 2-3 | 247 | 73 |
| BNIP3 | Hs00969293 | NM_004052.2 | 5-6 | 657 | 65 |
| ADM | Hs02562698 | NM_001124.1 | 4-4 | 1375 | 110 |
| EGLN3 | Hs00222966 | NM_022073.3 | 3-4 | 940 | 62 |
| P4HA2 | Hs00989996 | NM_001017973.1 | 14-15 | 2094 | 68 |
| ANKRD37 | Hs00699181 | NM_181726.2 | 3-4 | 506 | 70 |
| KCTD11 | Hs00922550 | NM_001002914.2 | 1-1 | 3006 | 98 |
| PDK1 | Hs00326943 | NM_002610.3 | 11-11 | 3124 | 97 |
| ALDOA | Hs00605108 | NM_184041.1 | 8-9 | 1230 | 129 |
| Reference genes: | | | | | |
| ACTR3 | Hs01029161 | NM_005721.3 | 2-3 | 419 | 70 |
| NDFIP1 | Hs00228968 | NM_030571.3 | 3-4 | 492 | 67 |
| RPL37A | Cf. Sequence below | NM_000998.4 | | | |

RPL37A:
```
                                           (SEQ ID NO: 50)
forward primer TGT GGT TCC TGC ATG AAG ACA
                                           (SEQ ID NO: 51)
reverse primer GTG ACA GCG AAA GTG GTA TTG TAC
                                           (SEQ ID NO: 52)
probe TG GCT GGC GGT GCC TGG A
```

SLC2A1:
```
                                           (SEQ ID NO: 47)
forward primer GCTACAACACTGGAGTCATCAATG,
                                           (SEQ ID NO: 48)
reverse primer TGTCTGGTTGTAGAACTCCTCGAT
                                           (SEQ ID NO: 49)
probe CCCCCCAGAAGGTG
```

Oligonucleotide comprising a sequence of 10-90 consecutive nucleic acid selected from SEQ ID NO: 1 or the complement thereof is capable of hybridising to transcripts of the ADM gene (SEQ ID No:1). Non limiting examples hereof are transcripts with SEQ ID NO.: 16.

Oligonucleotide comprising a sequence of 10-90 consecutive nucleic acid selected from SEQ ID NO: 2 or the complement thereof is capable of hybridising to transcripts of the ALDOA (SEQ ID NO.: 2), Non limiting examples hereof are transcripts with SEQ ID NO.: 17, 18, 19 and 20.

Oligonucleotide comprising a sequence of 10-90 consecutive nucleic acid selected from SEQ ID NO: 3 or the complement thereof ar capable of hybridising to transcripts of the ANKRD37 (SEQ ID NO.: 3). Non limiting examples hereof are transcripts with SEQ ID NO.: 21.

Oligonucleotide comprising a sequence of 10-90 consecutive nucleic acid selected from SEQ ID NO: 4 or the complement thereof is capable of hybridising to transcripts of the BNIP3 (SEQ ID NO.: 4). Non limiting examples hereof are transcripts with SEQ ID NO.: 22.

Oligonucleotide comprising a sequence of 10-90 consecutive nucleic acid selected from SEQ ID NO: 5 or the complement thereof is capable of hybridising to transcripts of the BNIP3L (SEQ ID NO.: 5). Non limiting examples hereof are transcripts with SEQ ID NO.: 23.

Oligonucleotide comprising a sequence of 10-90 consecutive nucleic acid selected from SEQ ID NO: 6 or the complement thereof is capable of hybridising to transcripts of the C3orf28 (SEQ ID NO.: 6). Non limiting examples hereof are transcripts with SEQ ID NO.: 24.

Oligonucleotide comprising a sequence of 10-90 consecutive nucleic acid selected from SEQ ID NO: 7 or the complement thereof is capable of hybridising to transcripts of the EGLN3 (SEQ ID NO.: 7). Non limiting examples hereof are transcripts with SEQ ID NO.: 25.

Oligonucleotide comprising a sequence of 10-90 consecutive nucleic acid selected from SEQ ID NO: 8 or the complement thereof is capable of hybridising to transcripts of the KCTD11 (SEQ ID NO.: 8) Non limiting examples hereof are transcripts with SEQ ID NO.: 26.

Oligonucleotide comprising a sequence of 10-90 consecutive nucleic acid selected from SEQ ID NO: 9 or the complement thereof is capable of hybridising to transcripts of the LOX (SEQ ID NO.: 9). Non limiting examples hereof are transcripts with SEQ ID NO.: 27 and 28.

Oligonucleotide comprising a sequence of 10-90 consecutive nucleic acid selected from SEQ ID NO: 10 or the complement thereof is capable of hybridising to transcripts of the NDRG1 (SEQ ID NO.: 10). Non limiting examples hereof are transcripts with SEQ ID NO.: 29 and 30.

Oligonucleotide comprising a sequence of 10-90 consecutive nucleic acid selected from SEQ ID NO: 11 or the complement thereof is capable of hybridising to transcripts of the P4HA1 (SEQ ID NO.: 11). Non limiting examples hereof are transcripts with SEQ ID NO.: 31 to 34.

Oligonucleotide comprising a sequence of 10-90 consecutive nucleic acid selected from SEQ ID NO: 12 or the complement thereof is capable of hybridising to transcripts of the P4HA2 (SEQ ID NO.: 12). Non limiting examples hereof are transcripts with SEQ ID NO.: 35-39.

Oligonucleotide comprising a sequence of 10-90 consecutive nucleic acid selected from SEQ ID NO: 13 or the complement thereof is capable of hybridising to transcripts of the PDK1 (SEQ ID NO.: 13). Non limiting examples hereof are transcripts with SEQ ID NO.: 40.

Oligonucleotide comprising a sequence of 10-90 consecutive nucleic acid selected from SEQ ID NO: 14 or the complement thereof is capable of hybridising to transcripts of the PFKFB3 (SEQ ID NO.: 14). Non limiting examples hereof are transcripts with SEQ ID NO.: 41 and 42.

Oligonucleotide comprising a sequence of 10-90 consecutive nucleic acid selected from SEQ ID NO: 1 or the complement thereof is capable of hybridising to transcripts of the SLC2A1 (SEQ ID NO.: 15).

Oligonucleotide (SEQ ID NO: 61) with nucleic acid sequence CCCCCCAGAAGGTG is capable of hybridising to transcripts of the SLC2A1 (SEQ ID NO: 15). Non limiting examples hereof are transcripts with SEQ ID NO.: 43.

Cancer

The present invention relates to methods for determining the oxygen status of a cancer, as well as methods and compositions and uses thereof for treating said cancer based on the determined oxygen status of the cancer. According to the present invention, the oxygen status is decisive for the chosen cancer treatment. Any cancer type may be subjected to the method of the present invention for determining oxygen status. Cancer types which are found to be characterized by low oxygen status/hypoxia may be treated with hypoxia-modifying agents. So, in a preferred embodiment, the methods, compositions and uses thereof are intended for the treatment of hypoxic cancers, i.e. a cancer characterized by low oxygen, wherein the subject suffering from said cancer is treated with a hypoxia-modifying agent.

In a preferred embodiment, cancer cells of the present invention are for example hypoxic cells. The cancer cells of the present invention are in one embodiment planocellular cancer cells, squamous cellular cancer cells, and/or may be selected from the group consisting of squamous cellular cancers of the head and neck, skin, esophagus, urinary bladder, prostate, lungs, vagina, and cervix. Non-limiting examples are squamous cell carcinoma, and squamous cellular cancer such as head and neck cancer, and the head and neck cancer is for example selected from the group consisting of cancer of the mouth, lips, cancer of the nasal cavity and nasopharyngeal cancer.

The cancer of the present invention include any cancer, in particular any cancer, for which oxygen status is relevant for prognosis, such as hypoxic cancers. In one embodiment, the cancer is a sarcoma. Thus, the cancer is in one embodiment selected from sarcomas. However, in another embodiment, the cancer is a carcinoma. In a more particular embodiment, the cancer is a carcinamo selected from the group consisting of planocelluar cancers, squamous cellular cancers and adenocarcinomas. In one particularly preferred embodiment, the cancer is a squamous cellular cancer, so the cancer is selected from squamous cellular cancers.

Squamous Cellular Cancers

Squamous cellular cancers are carcinomas derived from stratified squamous epithelium and also comprise cancers that occur in sites where glandular or columnar epithelium is normally present. Squamous epithelium is an epithelium characterised by its most superficial layer consisting of flat, scale-like cells called squamous cell. Epithelium may be composed of one layer of these cells, in which case it is referred to as simple squamous epithelium, or it may possess multiple layers, referred to then as stratified squamous epithelium. The group of squamous cellular cancers thus comprises squamous cell carcinomas in different parts of the body.

A carcinoma is defined as a malignant tumour that begins in the lining layer (epithelial cells) of organs. Carcinoma have a tendency to infiltrate into adjacent tissue and spread (metastasize) to distant organs, such as bone, liver, lung, or the brain. The present invention also relates to individuals suffering from squamous cellular cancer in the form of carcinoma in situ (CIS) which is an early form of carcinoma and is defined by the absence of invasion of surrounding tissues. In other words, carcinoma in situ is the abnormal growth of cells that proliferate in their normal habitat, hence the name 'in situ'. Carcinoma in situ is also equivalent to the term high grade dysplasia.

Squamous cellular cancer is selected from the group consisting of carcinoma of the head and neck, skin, esophagus, urinary bladder, prostate, lungs, vagina, and cervix. In one embodiment of the present invention the squamous cellular cancer is selected from the group consisting of head and neck, skin, esophagus, urinary bladder, prostate and lungs. In another embodiment of the present invention the squamous cellular cancer is selected from the group consisting of the head and neck, vagina, and cervix. In another embodiment of the present invention the squamous cellular cancer is selected from the group consisting of the head and neck, vagina, lungs and cervix. In another embodiment of the present invention the squamous cellular cancer is selected from the group consisting of the head and neck, vagina and cervix.

In a further embodiment of the present invention the squamous cellular cancer is selected from the group consisting of the head and neck, lungs and cervix. In a further embodiment of the present invention the squamous cellular cancer is selected from the group consisting of the head and neck, urinary bladder, prostate and lungs.

It is within the scope of the present invention that squamous cellular cancer is any cancer from the head and neck, skin, esophagus, urinary bladder, prostate, lungs, vagina, or cervix.

In a preferred embodiment of the present invention the squamous cellular cancer is cancer of the head and neck.

Head and neck cancers are found in cancers of the mouth, lips, oral cavity (mouth), cancer of the nasal cavity, paranasal sinuses, pharynx and larynx. Thus in one embodiment of the present invention the head and neck cancer is selected from the group consisting of cancer of the mouth, lips, cancer of the nasal cavity, pharynx and larynx. In another embodiment of the present invention the head and neck cancer is selected from the group consisting of cancer of the mouth and lips. In yet another embodiment of the present invention the head and neck cancer is selected from the group consisting of cancer of the nasal cavity and nasopharyngeal cancer. It is within the scope of the present invention that head and neck cancer is any cancer mouth, lips, cancer of the nasal cavity or nasopharyngeal cancer. Thus, head and neck cancers are for example cancers where the tumour is located in supraglottic larynx, hypopharynx, oropharynx, or rhinopharynx.

The stage of a squamous cellular cancer can be based on results obtained by physical examination, imaging tests or by pathological inspection of tissue following surgery. The present staging system is based on the pathologic conclusion drawn by a pathologist after examination of the tumour tissue and lymph nodes removed by surgery. The cancers of the present invention may be of any stage.

Carcinomas of the present invention may be staged according to defined characteristics relating to size and metastasising properties.

One staging system commonly used to divide cancers into stages is that of the AJCC-TNM system (American Joint Committee on Cancer (AJCC). Here the cancers are classified based on their T, N, and M stages, where T is an abbreviation for tumour (its size and how far it has spread within the organ and to nearby organs), N stands for spread to lymph nodes (bean-shaped collections of immune system cells that help fight infections and cancers) and M is for metastasis (spread to distant organs).

Additional letters or numbers may appear after T, N, and M to provide detailed information on the tumour, lymph nodes, and metastasis. T 0 to 4 describes the size of the tumour and spread to surrounding organs or skin, where higher T numbers indicate a large tumour and/or wider. Similarly, N followed by a number from 0 to 3 is indicative of whether the cancer has spread to lymph nodes near the primary tumour and, if so, how many lymph nodes are affected. In analogy, M denotes whether the cancer has spread to distant organs, where 0 is indicative for spreading to for example the lungs or bones, and 1 is indicative for spreading of the cancer to lymph nodes distant to the primary tumour.

The disease stage of the squamous cellular cancer is determined by combining the above features. Stage is expressed as stage 0 and in Roman numerals from stage I (the least advanced stage) to stage IV (the most advanced stage).

Stage 0 carcinoma in situ.

Stage I cancers are localized to one part of the body.

Stage II cancers are locally advanced.

Stage III cancers are also locally advanced. Whether a cancer is designated as Stage II or Stage III can depend on the specific type of cancer.

Stage IV cancers have often metastasized, or spread to other organs or throughout the body.

It is appreciated that the present invention pertains to cancer of any stage such as stage 0 (carcinoma in situ), I, IIA, IIB, IIIA, IIIB, IIIC or IV, and any of the above listed TNM stage.

Sample

It is appreciated that the sample to be analysed comprises cancer cells, such as any cancer type cell as described herein, for example squamous cellular cells. A sample is typically a biopsy of the cancer, such as planocellular cancer and/or squamous cellular cancer. The sample is fresh, frozen or formalin fixated. In a preferred embodiment the sample is a biopsy of cancer tumour cells, such as planocellular cancer and/or squamous cellular cancer tumour, that is formalin fixated.

Determination of Transcriptional Expression Level

Extraction of RNA

RNA or protein can be isolated and assayed from a test sample using any techniques known in the art. They can for example be isolated from a sample according to the present invention such as a fresh, formalin-fixated or frozen biopsy.

Methods of isolating total mRNA are well known to those of skill in the art. In one embodiment, the total nucleic acid is isolated from a given sample using, for example, an acid guanidinium-phenol-chloroform extraction method and polyA.sup. and mRNA is isolated by oligo dT column chromatography or by using (dT)n magnetic beads (see, e.g., Sambrook et al., Molecular Cloning: A Laboratory Manual (2nd ed.), Vols. 1-3, Cold Spring Harbor Laboratory, (1989), or Current Protocols in Molecular Biology, F. Ausubel et al., ed. Greene Publishing and Wiley-Interscience, New York (1987)).

The sample may be from tissue and/or body fluids, as defined elsewhere herein. Before analyzing the sample, e.g., on an oligonucleotide array, it will often be desirable to perform one or more sample preparation operations upon the sample. Typically, these sample preparation operations will include such manipulations as extraction of intracellular material, e.g., nucleic acids from whole cell samples, viruses, amplification of nucleic acids, fragmentation, transcription, labeling and/or extension reactions. One or more of these various operations may be readily incorporated into the device of the present invention.

For a number of applications, it may be desirable to extract and separate messenger RNA from cells, cellular debris, and other contaminants. As such, the device of the present invention may, in some cases, include a mRNA purification chamber or channel. In general, such purification takes advantage of the poly-A tails on mRNA. In particular and as noted above, poly-T oligonucleotides may be immobilized within a chamber or channel of the device to serve as affinity ligands for mRNA. Poly-T oligonucleotides may be immobilized upon a solid support incorporated within the chamber or channel, or alternatively, may be immobilized upon the surface(s) of the chamber or channel itself. Immobilization of oligonucleotides on the surface of the chambers or channels may be carried out by methods described herein including, e.g., oxidation and silanation of the surface followed by standard DMT synthesis of the oligonucleotides.

In operation, the lysed sample is introduced to a high salt solution to increase the ionic strength for hybridization, whereupon the mRNA will hybridize to the immobilized poly-T. The mRNA bound to the immobilized poly-T oligonucleotides is then washed free in a low ionic strength buffer. The poy-T oligonucleotides may be immobiliized upon poroussurfaces, e.g., porous silicon, zeolites silica xerogels, scintered particles, or other solid supports.

Hybridisation

Following sample preparation, the sample can be subjected to one or more different analysis operations. A variety of analysis operations may generally be performed, including size based analysis using, e.g., microcapillary electrophoresis, and/or sequence based analysis using, e.g., hybridization to an oligonucleotide array.

In the latter case, the nucleic acid sample may be probed using an array of oligonucleotide probes. Oligonucleotide arrays generally include a substrate having a large number of positionally distinct oligonucleotide probes attached to the substrate. These arrays may be produced using mechanical or light directed synthesis methods which incorporate a combination of photolithographic methods and solid phase oligonucleotide synthesis methods.

Affinity Matrices

The type of affinity matrix used depends on the purpose of the analysis. For example, where it is desired to analyze mRNA expression levels of particular genes in a complex nucleic acid sample (e.g., total mRNA) it is often desirable to eliminate nucleic acids produced by genes that are constitutively overexpressed and thereby tend to mask gene products expressed at characteristically lower levels. Thus, in one embodiment, the affinity matrix can be used to remove a number of preselected gene products (e.g., actin, GAPDH, etc.). This is accomplished by providing an affinity matrix bearing nucleic acid affinity ligands complementary to the gene products (e.g., mRNAs or nucleic acids derived therefrom) or to subsequences thereof. Hybridization of the nucleic acid sample to the affinity matrix will result in duplex formation between the affinity ligands and their target nucleic acids. Upon elution of the sample from the affinity matrix, the matrix will retain the duplexes nucleic acids leaving a sample depleted of the overexpressed target nucleic acids.

The affinity matrix can also be used to identify unknown mRNAs or cDNAs (complementary DNA synthesised from mRNA) in a sample. Where the affinity matrix contains nucleic acids complementary to every known gene (e.g., in a cDNA library, DNA reverse transcribed from an mRNA, mRNA used directly or amplified, or polymerized from a DNA template) in a sample, capture of the known nucleic acids by the affinity matrix leaves a sample enriched for those nucleic acid sequences that are unknown. In effect, the affinity matrix is used to perform a subtractive hybridization to isolate unknown nucleic acid sequences. The remaining "unknown" sequences can then be purified and sequenced according to standard methods.

The affinity matrix can also be used to capture (isolate) and thereby purify unknown nucleic acid sequences. For example, an affinity matrix can be prepared that contains nucleic acid (affinity ligands) that are complementary to sequences not previously identified, or not previously known to be expressed in a particular nucleic acid sample. The sample is then hybridized to the affinity matrix and those sequences that are retained on the affinity matrix are "unknown" nucleic acids. The retained nucleic acids can be eluted from the matrix (e.g. at increased temperature, increased destabilizing agent concentration, or decreased salt) and the nucleic acids can then be sequenced according to standard methods.

Similarly, the affinity matrix can be used to efficiently capture (isolate) a number of known nucleic acid sequences. Again, the matrix is prepared bearing nucleic acids complementary to those nucleic acids it is desired to isolate. The sample is contacted to the matrix under conditions where the complementary nucleic acid sequences hybridize to the affinity ligands in the matrix. The non-hybridized material is washed off the matrix leaving the desired sequences bound. The hybrid duplexes are then denatured providing a pool of the isolated nucleic acids. The different nucleic acids in the pool can be subsequently separated according to standard methods (e.g. gel electrophoresis).

As indicated above the affinity matrices can be used to selectively remove nucleic acids from virtually any sample containing nucleic acids (e.g. in a cDNA library, DNA reverse transcribed from an mRNA, mRNA used directly or amplified, or polymerized from a DNA template, and so forth). The nucleic acids adhering to the column can be removed by washing with a low salt concentration buffer, a buffer containing a destabilizing agent such as formamide, or by elevating the column temperature.

In one particularly preferred embodiment, the affinity matrix can be used in a method to enrich a sample for unknown RNA sequences (e.g. expressed sequence tags (ESTs)). The method involves first providing an affinity matrix bearing a library of oligonucleotide probes specific to known RNA (e.g., EST) sequences. Then, RNA from undifferentiated and/or unactivated cells and RNA from differentiated or activated or pathological (e.g., transformed) or otherwise having a different metabolic state are separately hybridized against the affinity matrices to provide two pools of RNAs lacking the known RNA sequences.

In a preferred embodiment, the affinity matrix is packed into a columnar casing. The sample is then applied to the affinity matrix (e.g. injected onto a column or applied to a column by a pump such as a sampling pump driven by an autosampler). The affinity matrix (e.g. affinity column) bearing the sample is subjected to conditions under which the nucleic acid probes comprising the affinity matrix hybridize specifically with complementary target nucleic acids. Such conditions are accomplished by maintaining appropriate pH, salt and temperature conditions to facilitate hybridization as discussed above.

For a number of applications, it may be desirable to extract and separate messenger RNA from cells, cellular debris, and other contaminants. As such, the device of the present invention may, in some cases, include a mRNA purification chamber or channel. In general, such purification takes advantage of the poly-A tails on mRNA. In particular and as noted above, poly-T oligonucleotides may be immobilized within a chamber or channel of the device to serve as affinity ligands for mRNA. Poly-T oligonucleotides may be immobilized upon a solid support incorporated within the chamber or channel, or alternatively, may be immobilized upon the surface(s) of the chamber or channel itself. Immobilization of oligonucleotides on the surface of the chambers or channels may be carried out by methods described herein including, e.g., oxidation and silanation of the surface followed by standard DMT synthesis of the oligonucleotides.

In operation, the lysed sample is introduced to a high salt solution to increase the ionic strength for hybridization, whereupon the mRNA will hybridize to the immobilized poly-T. The mRNA bound to the immobilized poly-T oligonucleotides is then washed free in a low ionic strength buffer. The poy-T oligonucleotides may be immobiliized upon poroussurfaces, e.g., porous silicon, zeolites silica xerogels, scintered particles, or other solid supports.

Light Directed Synthesis of Oligonuclotide Array

The basic strategy for light directed synthesis of oligonucleotide arrays is as follows. The surface of a solid support, modified with photosensitive protecting groups is illuminated through a photolithographic mask, yielding reactive hydroxyl groups in the illuminated regions. A selected nucleotide, typically in the form of a 3'-O-phosphoramidite-activated deoxynucleoside (protected at the 5' hydroxyl with a photosensitive protecting group), is then presented to the surface and coupling occurs at the sites that were exposed to light. Following capping and oxidation, the substrate is rinsed and the surface is illuminated through a second mask to expose additional hydroxyl groups for coupling. A second selected nucleotide (e.g., 5'-protected, 3'-O-phosphoramidite-activated deoxynucleoside) is presented to the surface. The selective deprotection and coupling cycles are repeated until the desired set of products is obtained. Since photolithography is used the process can be readily miniaturized to generate high density arrays of oligonucleotide probes. Furthermore, the sequence of the oligonucleotides at each site is known. See Pease et al. Mechanical synthesis methods are similar to the light directed methods except involving mechanical direction of fluids for deprotection and addition in the synthesis steps.

For some embodiments, oligonucleotide arrays may be prepared having all possible probes of a given length. The hybridization pattern of the target sequence on the array may be used to reconstruct the target DNA sequence. Hybridization analysis of large numbers of probes can be used to sequence long stretches of DNA or provide an oligonucleotide array which is specific and complementary to a particular nucleic acid sequence. For example, in particularly preferred aspects, the oligonucleotide array will contain oligonucleotide probes which are complementary to specific target sequences and individual or multiple mutations of these. Such arrays are particularly useful in the diagnosis of specific disorders which are characterized by the presence of a particular nucleic acid sequence.

Following sample collection and nucleic acid extraction, the nucleic acid portion of the sample is typically subjected to one or more preparative reactions. These preparative reactions include in vitro transcription, labelling, fragmentation, amplification and other reactions. Nucleic acid amplification increases the number of copies of the target nucleic acid sequence of interest. A variety of amplification methods are suitable for use in the methods and device of the present invention, including for example, the polymerase chain reaction method or (PCR), the ligase chain reaction (LCR), self sustained sequence replication (3SR), and nucleic acid based sequence amplification (NASBA).

The latter two amplification methods involve isothermal reactions based on isothermal transcription, which produce both single stranded RNA (ssRNA) and double stranded DNA (dsDNA) as the amplification products in a ratio of approximately 30 or 100 to 1, respectively. As a result, where these latter methods are employed, sequence analysis may be carried out using either type of substrate, i.e. complementary to either DNA or RNA.

Frequently, it is desirable to amplify the nucleic acid sample prior to hybridization. One of skill in the art will appreciate that whatever amplification method is used, if a quantitative result is desired, care must be taken to use a method that maintains or controls for the relative frequencies of the amplified nucleic acids.

Determining Transcriptional Expression Levels

Expression of genes may in general be detected by either detecting mRNA from the cells and/or detecting expression products, such as peptides and proteins.

Polymerase Chain reaction (PCR) is a well known and well established technique to determine transcriptional products and therefore also a method that in one embodiment is used to determine the transcriptional expression level of the gene(s), or variant thereof of the present invention.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. The high density array may then include probes specific to the internal standard for quantification of the amplified nucleic acid.

Thus, in one embodiment, this invention provides for a method of optimizing a probe set for detection of a particular gene. Generally, this method involves providing a high density array containing a multiplicity of probes of one or more particular length(s) that are complementary to subsequences of the mRNA transcribed by the target gene. In one embodiment the high density array may contain every probe of a particular length that is complementary to a particular mRNA. The probes of the high density array are then hybridized with their target nucleic acid alone and then hybridized with a high complexity, high concentration nucleic acid sample that does not contain the targets complementary to the probes. Thus, for example, where the target nucleic acid is an RNA, the probes are first hybridized with their target nucleic acid alone and then hybridized with RNA made from a cDNA library (e.g., reverse transcribed polyA-.sup.+mRNA) where the sense of the hybridized RNA is opposite that of the target nucleic acid (to insure that the high complexity sample does not contain targets for the probes). Those probes that show a strong hybridization signal with their target and little or no cross-hybridization with the high complexity sample are preferred probes for use in the high density arrays of this invention.

PCR amplification generally involves the use of one strand of the target nucleic acid sequence as a template for producing a large number of complements to that sequence. Generally, two primer sequences complementary to different ends of a segment of the complementary strands of the target sequence hybridize with their respective strands of the target sequence, and in the presence of polymerase enzymes and nucleoside triphosphates, the primers are extended along the target sequence. The extensions are melted from the target sequence and the process is repeated, this time with the additional copies of the target sequence synthesized in the preceding steps. PCR amplification typically involves repeated cycles of denaturation, hybridization and extension reactions to produce sufficient amounts of the target nucleic acid. The first step of each cycle of the PCR involves the separation of the nucleic acid duplex formed by the primer extension. Once the strands are separated, the next step in PCR involves hybridizing the separated strands with primers that flank the target sequence. The primers are then extended to form complementary copies of the target strands. For successful PCR amplification, the primers are designed so that the position at which each primer hybridizes along a duplex sequence is such that an extension product synthesized from one primer, when separated from the template (complement), serves as a template for the extension of the other primer. The cycle of denaturation, hybridization, and extension is repeated as many times as necessary to obtain the desired amount of amplified nucleic acid.

In PCR methods, strand separation is normally achieved by heating the reaction to a sufficiently high temperature for a sufficient time to cause the denaturation of the duplex but not to cause an irreversible denaturation of the polymerase. Typical heat denaturation involves temperatures ranging from about 80.degree C. to 105.degree C. for times ranging from seconds to minutes. Strand separation, however, can be accomplished by any suitable denaturing method including physical, chemical, or enzymatic means. Strand separation may be induced by a helicase, for example, or an enzyme capable of exhibiting helicase activity.

In addition to PCR and IVT reactions, the methods of the present invention are also applicable to a number of other reaction types, e.g., reverse transcription, nick translation, and the like.

Labelling Prior to Hybridisation

The nucleic acids in a sample will generally be labelled to facilitate detection in subsequent steps. Labelling may be carried out during the amplification, in vitro transcription or nick translation processes. In particular, amplification, in vitro transcription or nick translation may incorporate a label into the amplified or transcribed sequence, either through the use of labelled primers or the incorporation of labelled dNTPs into the amplified sequence.

Hybridization between the sample nucleic acid and the oligonucleotide probes upon the array is then detected, using, e.g., epifluorescence confocal microscopy. Typically, sample is mixed during hybridization to enhance hybridization of nucleic acids in the sample to nucleic acid probes on the array.

Labelling After Hybridisation

In some cases, hybridized oligonucleotides may be labelled following hybridization. For example, where biotin labelled dNTPs are used in, e.g. amplification or transcription, streptavidin linked reporter groups may be used to label hybridized complexes. Such operations can readily be integrated into the systems of the present invention. Alternatively, the nucleic acids in the sample may be labelled following amplification. Post amplification labelling typically involves the covalent attachment of a particular detectable group upon the amplified sequences. Suitable labels or detectable groups include a variety of fluorescent or radioactive labelling groups well known in the art. These labels may also be coupled to the sequences using methods that are well known in the art.

Methods for detection of a desired transcript or part thereof depend upon the label selected. A fluorescent label is preferred because of its extreme sensitivity and simplicity. Standard labelling procedures are used to determine the positions where interactions between a sequence and a reagent take place. For example, if a target sequence is labelled and exposed to a matrix of different probes, only those locations where probes do interact with the target will exhibit any signal. Alternatively, other methods may be used to scan the matrix to determine where interaction takes place. Of course, the spectrum of interactions may be determined in a temporal manner by repeated scans of interactions which occur at each of a multiplicity of conditions. However, instead of testing each individual interaction separately, a multiplicity of sequence interactions may be simultaneously determined on a matrix.

Means of detecting labelled target (sample) may be nucleic acids hybridized to the probes of the high density array are known to those of skill in the art. Thus, for example, where a colorimetric label is used, simple visualization of the label is sufficient. Where a radioactive labelled probe is used, detection of the radiation (e.g. with photographic film or a solid state detector) is sufficient.

In a preferred embodiment, however, the target nucleic acids are labelled with a fluorescent label and the localization of the label on the probe array is accomplished with fluorescent microscopy. The hybridized array is excited with a light source at the excitation wavelength of the particular fluorescent label and the resulting fluorescence at the emission wavelength is detected. In a particularly preferred embodiment, the excitation light source is a laser appropriate for the excitation of the fluorescent label.

The target polynucleotide may be labelled by any of a number of convenient detectable markers. A fluorescent label is preferred because it provides a very strong signal with low background. It is also optically detectable at high resolution and sensitivity through a quick scanning procedure. Other potential labelling moieties include, radioisotopes, chemiluminescent compounds, labelled binding proteins, heavy metal atoms, spectroscopic markers, magnetic labels, and linked enzymes.

Another method for labelling may bypass any label of the target sequence. The target may be exposed to the probes, and a double strand hybrid is formed at those positions only. Addition of a double strand specific reagent will detect where hybridization takes place. An intercalative dye such as ethidium bromide may be used as long as the probes themselves do not fold back on themselves to a significant extent forming hairpin loops. However, the length of the hairpin loops in short oligonucleotide probes would typically be insufficient to form a stable duplex.

Suitable chromogens will include molecules and compounds which absorb light in a distinctive range of wavelengths so that a color may be observed, or emit light when irradiated with radiation of a particular wave length or wave length range, e.g., fluorescers. Biliproteins, e.g., phycoerythrin, may also serve as labels.

A wide variety of suitable dyes are available, being primarily chosen to provide an intense color with minimal absorption by their surroundings. Illustrative dye types include quinoline dyes, triarylmethane dyes, acridine dyes, alizarine dyes, phthaleins, insect dyes, azo dyes, anthraquinoid dyes, cyanine dyes, phenazathionium dyes, and phenazoxonium dyes.

A wide variety of fluorescers may be employed either by themselves or in conjunction with quencher molecules. Fluorescers of interest fall into a variety of categories having certain primary functionalities. These primary functionalities include 1- and 2-aminonaphthalene, p,p'-diaminostilbenes, pyrenes, quaternary phenanthridine salts, 9-aminoacridines, p,p'-diaminobenzophenone imines, anthracenes, oxacarbocyanine, merocyanine, 3-aminoequilenin, perylene, bis-benzoxazole, bis-p-oxazolyl benzene, 1,2-benzophenazin, retinol, bis-3-aminopyridinium salts, hellebrigenin, tetracycline, sterophenol, benzimidzaolylphenylamine, 2-oxo-3-chromen, indole, xanthen, 7-hydroxycoumarin, phenoxazine, salicylate, strophanthidin, porphyrins, triarylmethanes and flavin. Individual fluorescent compounds which have functionalities for linking or which can be modified to incorporate such functionalities include, e.g., dansyl chloride; fluoresceins such as 3,6-dihydroxy-9-phenylxanthhydrol; rhodamineisothiocyanate; N-phenyl 1-amino-8-sulfonatonaphthalene; N-phenyl 2-amino-6-sulfonatonaphthalene; 4-acetamido-4-isothiocyanato-stilbene-2,2'-disulfonic acid; pyrene-3-sulfonic acid; 2-toluidinonaphthalene-6-sulfonate; N-phenyl, N-methyl 2-aminoaphthalene-6-sulfonate;

ethidium bromide; stebrine; auromine-0,2-(9'-anthroyl) palmitate; dansyl phosphatidylethanolamine; N,N'-dioctadecyl oxacarbocyanine; N,N'-dihexyl oxacarbocyanine; merocyanine, 4-(3'pyrenyl)butyrate; d-3-aminodesoxy-equilenin; 12-(9'-anthroyl)stearate; 2-methylanthracene; 9-vinylanthracene; 2,2'-(vinylene-p-phenylene)bisbenzoxazole; p-bis>2-(4-methyl-5-phenyl-oxazolyl)!benzene; 6-dimethylamino-1,2-benzophenazin; retinol; bis(3'-aminopyridinium) 1,10-decandiyl diiodide; sulfonaphthylhydrazone of hellibrienin; chlorotetracycline; N-(7-dimethylamino-4-methyl-2-oxo-3-chromenyl)maleimide; N->p-(2-benzimidazolyl)-phenylmaleimide; N-(4-fluoranthyl)maleimide; bis (homovanillic acid); resazarin; 4-chloro-7-nitro-2,1,3-benzooxadiazole; merocyanine 540; resorufin; rose bengal; and 2,4-diphenyl-3(2H)-furanone.

Desirably, fluorescers should absorb light above about 300 nm, preferably about 350 nm, and more preferably above about 400 nm, usually emitting at wavelengths greater than about 10 nm higher than the wavelength of the light absorbed. It should be noted that the absorption and emission characteristics of the bound dye may differ from the unbound dye. Therefore, when referring to the various wavelength ranges and characteristics of the dyes, it is intended to indicate the dyes as employed and not the dye which is unconjugated and characterized in an arbitrary solvent.

Fluorescers are generally preferred because by irradiating a fluorescer with light, one can obtain a plurality of emissions. Thus, a single label can provide for a plurality of measurable events.

Detectable signal may also be provided by chemiluminescent and bioluminescent sources. Chemiluminescent sources include a compound which becomes electronically excited by a chemical reaction and may then emit light which serves as the detectible signal or donates energy to a fluorescent acceptor. A diverse number of families of compounds have been found to provide chemiluminescence under a variety of conditions. One family of compounds is 2,3-dihydro-1,-4-phthalazinedione. The most popular compound is luminol, which is the 5-amino compound. Other members of the family include the 5-amino-6,7,8-trimethoxy- and the dimethylamino>ca!benz analog. These compounds can be made to luminescence with alkaline hydrogen peroxide or calcium hypochlorite and base. Another family of compounds is the 2,4,5-triphenylimidazoles, with lophine as the common name for the parent product. Chemiluminescent analogs include para-dimethylamino and -methoxy substituents. Chemiluminescence may also be obtained with oxalates, usually oxalyl active esters, e.g., p-nitrophenyl and a peroxide, e.g., hydrogen peroxide, under basic conditions. Alternatively, luciferins may be used in conjunction with luciferase or lucigenins to provide bioluminescence.

Spin labels are provided by reporter molecules with an unpaired electron spin which can be detected by electron spin resonance (ESR) spectroscopy. Exemplary spin labels include organic free radicals, transitional metal complexes, particularly vanadium, copper, iron, and manganese, and the like. Exemplary spin labels include nitroxide free radicals.

In addition, amplified sequences may be subjected to other post amplification treatments. For example, in some cases, it may be desirable to fragment the sequence prior to hybridization with an oligonucleotide array, in order to provide segments which are more readily accessible to the probes, which avoid looping and/or hybridization to multiple probes. Fragmentation of the nucleic acids may generally be carried out by physical, chemical or enzymatic methods that are known in the art.

Following the various sample preparation operations, the sample will generally be subjected to one or more analysis operations. Particularly preferred analysis operations include, e.g. sequence based analyses using an oligonucleotide array and/or size based analyses using, e.g. microcapillary array electrophoresis.

In some embodiments it may be desirable to provide additional or alternative means for analyzing the nucleic acids from the sample Microcapillary array electrophoresis generally involves the use of a thin capillary or channel which may or may not be filled with a particular separation medium. Electrophoresis of a sample through the capillary provides a size based separation profile for the sample. Microcapillary array electrophoresis generally provides a rapid method for size based sequencing, PCR product analysis and restriction fragment sizing. The high surface to volume ratio of these capillaries allows for the application of higher electric fields across the capillary without substantial thermal variation across the capillary, consequently allowing for more rapid separations. Furthermore, when combined with confocal imaging methods these methods provide sensitivity in the range of atto-moles, which is comparable to the sensitivity of radioactive sequencing methods.

In many capillary electrophoresis methods, the capillaries e.g. fused silica capillaries or channels etched, machined or molded into planar substrates, are filled with an appropriate separation/sieving matrix. Typically, a variety of sieving matrices are known in the art may be used in the microcapillary arrays. Examples of such matrices include, e.g. hydroxyethyl cellulose, polyacrylamide and agarose. Gel matrices may be introduced and polymerized within the capillary channel. However, in some cases this may result in entrapment of bubbles within the channels which can interfere with sample separations. Accordingly, it is often desirable to place a preformed separation matrix within the capillary channel(s), prior to mating the planar elements of the capillary portion. Fixing the two parts, e.g. through sonic welding, permanently fixes the matrix within the channel. Polymerization outside of the channels helps to ensure that no bubbles are formed. Further, the pressure of the welding process helps to ensure a void-free system.

In addition to its use in nucleic acid "fingerprinting" and other sized based analyses the capillary arrays may also be used in sequencing applications. In particular, gel based sequencing techniques may be readily adapted for capillary array electrophoresis.

Transcriptional expression products from the gene(s) of the present invention may be detected as indications of cancer, such as planocellular cancer and/or squamous cellular cancer of the sample tested, such as diagnosing in an individual. The transcriptional expression product of the gene(s) of the present invention may be detected a sample according to the present invention.

The skilled person knows how to perform and choose between the various methods for determining the transcriptional expression level of desired genen(s). Thus, the method for determining the transcriptional expression level is not limited to those of the present invention. In short, the inventors have employed a quantitative RT-qPCR based technique, wherein cDNA was generated from isolated RNA. To detect transcripts, a TaqMan Gene expression assay was employed.

Determination of Oxygen Status and Genes Correlating Thereto

Determining the oxygen status of a cancer, such as planocellular cancer and/or squamous cellular cancer with the present invention serves to characterise the cancer as having a low degree of hypoxia or as having a high degree of hypoxia which is determining for which treatment subsequently to offer an individual suffering from said cancer. To determine the oxygen status the present invention makes use of cut-off values that have been determined using a tranining set as described below and herein in example 1.

Hypoxia can be transient (acute) or be of a more chronic nature. In general a tumour is considered to be hypoxic if the oxygen level is below 20 mm Hg. The exogenic hypoxic tracers relieve hypoxic areas at oxygen levels below 10 mmHg. When the oxygen level is around 2.5 to 5 mm Hg resistance to radiation is pronounced.

In general a cut-off value is established through the use of a training set of hypoxic samples of individuals suffering from cancers, such as planocellular cancers and/or squamous cellular cancers, where the oxygen status is known (determined by traditional methods such as for example oxygen-sensing electrodes, hypoxic tracers or the like). The samples are divided into two predefined groups that the method for determining oxygen status is expected to be able to distinguish between. One group is the predefined 'more hypoxic' group characterised for example as having the highest relative numbers of measurements below 2.5 mm Hg. The second group is the 'less hypoxic' group which for example contains the rest of the hypoxic samples.

Subsequently, the transcriptional expression level of a number of genes is determined and correlated to the known oxygen status. This way, genes that are differentially expressed can be separated into the two groups. Based on the performance (B/W-ratio) of previously validated hypoxia responsive genes, the patients can be split into a "more" and a "less" hypoxic group. The ability of each gene to separate the two groups from each other can be described with a B/W-ratio. The higher the ratio, the more distance in the expression of the gene in question between the two groups. Therefore the power to classify independent samples into one of the groups is more optimal with a high B/W-ratio, than with a low B/W-ratio.

B/W-Ratio:

$$B = \frac{1}{K-1} \sum_i n_i (\bar{z}_i - \bar{z})^2,$$

K is the number of groups, i is related to the group and $\bar{z}$ is the mean of all samples (n in total). B is a weighted sum of how far the mean of group i is to the global mean.

$$W = \frac{1}{n-K} \sum_i (n_i - 1) s_i^2,$$

$s_i^2$ is an estimate of the variance in group i. W is a weighted sum of the variance estimates constituting a "common" variance.

Using a Leave One Out (LOO) analysis the independence of the training set samples is estimated. Each sample being classified is excluded from the samples building up a classifier and does not influence the mean and variance in any of the pre-defined groups that makes up the classifier.

The most optimal combination of genes to classify independent samples as belonging to either the "more" or the "less" hypoxic group can be identified by performing a Leave One Out Cross Validation analysis (LOOCV). By excluding one sample from the training set at the time and then build a classifier from the rest of the samples independence is estimated. As there is variation in the expression values of the specific samples, the ranking of genes based on the B/W-ratio differs, which potentially makes the genes in the classifier change, when each individual sample is to be classified. Therefore a "15 gene classifier" might not constitute the exact same combination of genes, throughout the classification of all samples. The combination of for example 15 genes in the classifier may obtain the highest number of samples classified correctly.

Thus, it is appreciated that an obtained cut-off value may differ in relation to which specific samples that are used for example whether the samples are formalin fixated or fresh also in comparison with the training set samples used to determine the cut-off value for a sample being 'more' or 'less' hypoxic. The condition under which the transcriptional expression level is determined may also influence the cut-off value (buffer condition, selection of platform for transcriptional expression determination, selection of reference genes not affected by hypoxia status of the cancer, such as planocellular cancer and/or squamous cellular cancer, to normalise the transcriptional expression level of any of the genes identified by SEQ ID NO.: 1 to 15 in a sample and so forth. However, it is appreciated that determination of the oxygen level of an individual using other conditions that those of the present invention will be within the scope of the present invention if the oxygen status characterised as a high or low degree of hypoxia, if using the conditions as disclosed in the present invention would result in the classification of the cancer, such as planocellular cancer and/or squamous cellular cancer, as having a high or low degree of hypoxia according to the specific conditions of the present invention.

The conditions used for establishing a cut off value based on a training set, should be similar to the conditions when using samples of unknown oxygen status.

The cut-off value for correlating the transcriptional level of the genes identified by SEQ ID NO.: 1 to 15 and obtaining an oxygen status of a cancer, such as planocellular cancer and/or squamous cellular cancer, is given below.

Cycle Threshold Values for Determining Hypoxia

The classification of oxygen status of a cancer as low oxygen or high oxygen is preferably determined by comparing the correlated transcriptional expression level of the determined genes with correlated transcriptional expression level of the same genes of two reference samples comprising cancer cells characterized by a high and low oxygen level, respectively. The cancer cells comprised in the reference samples have been predetermined as hypoxic or non-hypoxic/low or high oxygen level by known methods, cf. e.g. example 2.

The oxygen status is preferably evaluated by calculating the difference (D) between the correlated transcriptional expression level of chosen genes with the correlated transcriptional expression level of the same one or more genes of the predetermined reference sample having a high oxygen level and a predetermined reference sample having a low oxygen level. The distance can be calculates as $$D_i = \sum_m \frac{(y_m - z_{im})^2}{W_m}$$

wherein m refers to the mth gene out of the genes of ii), i is the 'low oxygen' or 'high oxygen' reference sample, z is the mean expression level of the reference sample, W is the calculated common variance and y is the transcriptional gene expression of the sample comprising cancer cells. The cancer sample then has a high oxygen level if the distance (D) between the sample comprising cancer cells and the high oxygen reference sample is smaller than the distance (D) between the sample comprising cancer cells and the low oxygen reference sample. Inversely, the sample has a low oxygen level if the distance (D) between the sample comprising cancer cells and the low oxygen reference sample is smaller than the distance (D) between the sample comprising cancer cells and the high oxygen reference sample.

The transcriptional expression level of the determined one or more genes is correlated to at least one reference gene, preferably by subtracting the geometric mean of the cycle threshold (Ct) values of each of the at least one, such as three, reference genes from the Ct value of the one or more determined genes giving $\Delta Ct$, transforming the expression value of the one or more determined genes to fold difference relative to said reference genes by calculating $2^{-\Delta Ct}$, and log 2-transforming the fold difference giving the gene expression value (y), equalling ($-\Delta Ct$).

The geometric mean is a type of mean or average, which indicates the central tendency or typical value of a set of numbers.

The geometric mean is similar to the arithmetic mean, except that the numbers are multiplied and then the nth root (where n is the count of numbers in the set) of the resulting product is taken. For instance, the geometric mean of two numbers, say 2 and 8, is just the square root of their product; that is $\sqrt[2]{2 \times 8} = 4$. As another example, the geometric mean of the three numbers 4, 1, and 1/32 is the cube root of their product (1/8), which is 1/2; that is $\sqrt[3]{4 \times 1 \times 1/32} = 1/2$.

More generally, if the numbers are $x_1, \ldots, x_n$, the geometric mean G satisfies $$G = \sqrt[n]{x_1 x_2 \ldots x_n},$$

and hence $$\log G = \frac{1}{n} \sum_{i=1}^n \log x_i.$$

For each of the genes of the present invention, the mean $(-\Delta Ct)$-value is correlated to to at least one reference gene, in particular one or more of ACTR3, NDFIP1, and RPL37A, and preferably, the mean $(-\Delta Ct)$-value is correlated specifically to ACTR3, NDFIP1 and RPL37A, for example the geometric mean value of the expression of these genes. The Ct value corresponds to the cycle threshold, and is defined as the number of cycles required for a qPCR fluorescent signal to cross a threshold chosen on the basis of the baseline variability.

Thus, in a preferred embodiment, the mean $\Delta Ct$-value for each gene of the present invention correlated to ACTR3, NDFIP1 and RPL37A is for each gene as indicated in table 2a and/or 2b for the "more hypoxic group" and "less hypoxic group". Accordingly, the oxygen status of a cancer is classified as low oxygen/(more) hypoxic if the correlated transcriptional level of the genes of table 2a and/or 2b falls within the ranges indicated in table 2a and/or 2b for the "more hypoxic group", and conversely, the the oxygen status is classified as high oxygen/less hypoxic if the correlated transcriptional level of the genes of table 2a and/or 2b falls within the ranges indicated in table 2a and/or 2b for the "less hypoxic group".

TABLE 2

Intervals for the mean $(-\Delta Ct)$-value $(z_{im})$ and variance $(W_m)$, correlated to ACTR3, NDFIP1 and RPL37A. Mean values are expressed as the log2-transformed fold difference in expression levels between each test genes and the reference genes. Fold difference is calculated as $2^{-\Delta Ct}$. $\Delta Ct$ is calculated as the Ct value of the test gene minus the Ct value of the reference genes. The Ct value of the reference genes is the geometric mean of the Ct values of each of the three reference genes. The Ct value (cycle threshold) is defined as the number of cycles required for the fluorescent signal to cross a certain threshold. The threshold is an arbitrary level of fluorescence chosen on the basis of the baseline variability. Such determination of threshold levels is well known to those of skill in the art.

| Gene | 'more hypoxic' group Mean ΔCt | Variance | 'less hypoxic' group Mean ΔCt | Variance | Estimated common variance |
|---|---|---|---|---|---|
| ADM | −1.00 to −0.25 | 0.60-0.85 | −2.60 to −2.00 | 1.00-2.00 | 1.00-2.00 |
| ANKRD37 | −4.50 to −4.00 | 1.00-1.50 | −6.00 to −5.00 | 0.00-1.00 | 0.25-1.25 |
| P4HA2 | −3.00 to −2.25 | 0.00-0.50 | −4.75 to −3.5 | 0.50-1.50 | 0.25-1.25 |
| NDRG1 | 2.00 to 3.00 | 1.25-1.75 | 0.00 to 1.50 | 1.50-2.50 | 1.50-2.50 |
| SLC2A1 | 1.50 to 2.50 | 1.00-1.75 | 0.00 to 1.00 | 1.25-2.25 | 1.00-2.75 |
| P4HA1 | −5.25 to −4.50 | 1.50-2.50 | −7.00 to −5.75 | 1.25-2.25 | 1.00-2.00 |
| LOX | −1.25 to −0.75 | 1.25-2.00 | −3.00 to −1.50 | 1.50-2.50 | 1.50-2.50 |
| C3orf28 | −1.00 to 0.00 | 0.25-1.25 | −2.00 to −0.75 | 0.00-1.00 | 0.10-1.25 |
| BNIP3L | −1.00 to 0.00 | 0.00-1.00 | −2.00 to −0.75 | 0.00-1.00 | 0.25-1.25 |
| BNIP3 | −1.00 to 0.00 | 0.00-1.00 | −2.00 to −0.75 | 1.00-2.00 | 1.00-2.00 |
| EGLN3 | −1.00 to 0.00 | 1.50-2.50 | −2.00 to −0.75 | 1.00-2.00 | 1.00-2.00 |
| PDK1 | −2.00 to −1.25 | 0.00-1.00 | −3.00 to −2.00 | 0.00-1.00 | 0.10-1.25 |
| PFKFB3 | 0.00 to 1.00 | 0.50-1.50 | −1.00 to −2.00 | 1.00-2.75 | 1.00-2.00 |
| KCTD11 | −2.5 to −1.50 | 2.00-2.75 | −3.75 to −2.75 | 1.25-2.25 | 1.00-2.50 |
| ALDOA | −1.00 to 0.00 | 0.75-1.75 | −2.00 to −0.75 | 1.00-2.00 | 1.00-2.00 |

TABLE 2b similar to table 2a, but with different preferred values for mean $(-\Delta Ct)$-value $(z_{im})$ and variance $(W_m)$, correlated to ACTR3, NDFIP1 and RPL37A.

| Gene | 'more hypoxic' group Mean ΔCt | Variance | 'less hypoxic' group Mean ΔCt | Variance | Estimated common variance |
|---|---|---|---|---|---|
| ADM | −1.00 to −0.25 |  | −2.60 to −2.00 |  |  |
|  | −1.25 to −0.25 | 0.60-0.85 | −2.85 to −1.85 | 1.00-2.00 | 1.00-2.00 |
|  | −1.75 to 0.25 | 0.50-1.00 | −3.35 to −1.35 | 1.25-1.75 | 0.90-1.90 |
| ANKRD37 | −4.50 to −4.00 |  | −6.00 to −5.00 |  |  |
|  | −4.65 to −3.65 | 1.00-1.50 | −6.15 to −5.15 | 0.00-1.00 | 0.25-1.25 |
|  | −5.15 to −3.15 | 1.10-1.60 | −6.65 to −4.65 | 0.35-0.85 | 0.20-1.20 |
| P4HA2 | −3.00 to −2.25 |  | −4.75 to −3.5 |  |  |
|  | −3.20 to −2.20 | 0.00-0.50 | −4.70 to −3.70 | 0.50-1.50 | 0.25-1.25 |
|  | −1.25 to −0.25 | 0.00-0.50 | −5.20 to −3.20 | 0.75-1.25 | 0.40-1.40 |
| NDRG1 | 2.00 to 3.00 |  | 0.00 to 1.50 |  |  |
|  | 1.85 to 2.85 | 1.25-1.75 | 0.35 to 1.35 | 1.50-2.50 | 1.90 |
|  | 1.35 to 3.35 | 1.25-1.75 | −0.15 to 1.85 | 1.75-2.25 | 1.40-2.40 |
| SLC2A1 | 1.50 to 2.50 |  | 0.00 to 1.00 |  |  |
|  | 1.45 to 2.45 | 1.00-1.75 | 0.00 to 1.00 | 1.25-2.25 | 1.77 |
|  | 0.95 to 2.95 | 1.05-1.55 | −1.25 to −0.25 | 1.60-2.10 | 1.25-2.25 |
| P4HA1 | −5.25 to −4.50 |  | −7.00 to −5.75 |  |  |
|  | −5.40 to −4.40 | 1.50-2.50 | −6.85 to −5.85 | 1.25-2.25 | 1.00-2.00 |
|  | −5.90 to −3.90 | 1.75-2.25 | −7.35 to −5.35 | 0.90-1.40 | 0.85-1.85 |
| LOX | −1.25 to −0.75 |  | −3.00 to −1.50 |  |  |
|  | −1.60 to −0.60 | 1.25-2.00 | −2.95 to −1.95 | 1.50-2.50 | 1.92 |
|  | −2.10 to −0.10 | 1.45-1.95 | −3.45 to −1.45 | 0.65-0.85 | 0.65-0.85 |

TABLE 2b-continued similar to table 2a, but with different preferred values for mean (−ΔCt)-value ($z_{im}$) and variance ($W_m$), correlated to ACTR3, NDFIP1 and RPL37A.

| Gene | 'more hypoxic' group Mean ΔCt | Variance | 'less hypoxic' group Mean ΔCt | Variance | Estimated common variance |
|---|---|---|---|---|---|
| C3orf28 | −1.00 to 0.00 | | −2.00 to −0.75 | | |
| | −1.15 to −0.15 | 0.25-1.25 | −1.80 to −0.80 | 0.00-1.00 | 0.10-1.25 |
| | −1.65 to 0.35 | 0.45-0.95 | −2.30 to −0.30 | 0.25-0.75 | 0.00-1.00 |
| BNIP3L | −1.00 to 0.00 | | −2.00 to −0.75 | | |
| | −0.95 to 0.05 | 0.00-1.00 | −1.60 to −0.60 | 0.00-1.00 | 0.25-1.25 |
| | −1.45 to 0.55 | 0.05-0.55 | −2.10 to −0.10 | 0.05-0.55 | 0.00-1.00 |
| BNIP3 | −1.00 to 0.00 | | −2.00 to −0.75 | | |
| | −1.15 to −0.15 | 0.00-1.00 | −2.00 to −1.00 | 1.00-2.00 | 1.00-2.00 |
| | −1.65 to 0.35 | 0.25-0.75 | −2.50 to −0.50 | 1.25-1.75 | 0.75-1.75 |
| EGLN3 | −1.00 to 0.00 | | −2.00 to −0.75 | | |
| | −1.05 to −0.05 | 1.50-2.50 | −2.05 to −1.05 | 1.00-2.00 | 1.00-2.00 |
| | −1.55 to 0.45 | 1.85-2.35 | −2.55 to −0.55 | 1.20-1.70 | 1.05-2.05 |
| PDK1 | −2.00 to −1.25 | | −3.00 to −2.00 | | |
| | −2.20 to −1.20 | 0.00-1.00 | −2.80 to −1.80 | 0.00-1.00 | 0.10-1.25 |
| | −2.70 to −0.70 | 0.35-0.85 | −3.30 to −1.30 | 0.25-0.75 | 0.00-1.00 |
| PFKFB3 | 0.00 to 1.00 | | −1.00 to −2.00 | | |
| | −0.05 to 0.95 | 0.50-1.50 | −0.75 to 0.25 | 1.00-2.75 | 1.00-2.00 |
| | −0.55 to 1.45 | 0.70-1.20 | −1.25 to 0.75 | 0.95-1.45 | 0.65-1.65 |
| KCTD11 | −2.5 to −1.50 | | −3.75 to −2.75 | | |
| | −2.60 to −1.60 | 2.00-2.75 | −3.65 to −2.65 | 1.25-2.25 | 1.00-2.50 |
| | −3.10 to −1.10 | 2.10-2.60 | −4.15 to −2.15 | 1 55-2.05 | 1.35-2.35 |
| ALDOA | −1.00 to 0.00 | 0.75-1.75 | −2.00 to −0.75 | 1.00-2.00 | 1.00-2.00 |
| | −1.10 to −0.10 | 0.90-1.40 | −2.05 to −1.05 | 1.25-1.75 | 0.95-1.95 |
| | −1.60 to 0.40 | | −2.55 to −0.55 | | |

In a more specific embodiment, the the mean ΔCt-value for each gene of the present invention correlated to ACTR3, NDFIP1 and RPL37A is exactly, or approximately within 1.0, such as 0.9, such as 0.8, such as 0.7, such as 0.6, such as 0.5, such as 0.4, such as 0.3, such as 0.2, such as 0.1, such as 0.05 of the values indicated in table 3 for the "more hypoxic group" and "less hypoxic group", respectively.

TABLE 3

Mean ΔCt-value and common variance for genes correlated to ACTR3, NDFIP1 and RPL37A.

| Gene | Mean/Variance of 'more hypoxic' group | Mean/Variance of 'less hypoxic' group | Estimated common variance |
|---|---|---|---|
| ADM | −0.75/0.77 | −2.35/1.54 | 1.40 |
| ANKRD37 | −4.16/1.35 | −5.65/0.60 | 0.70 |
| P4HA2 | −2.71/0.11 | −4.21/1.01 | 0.90 |
| NDRG1 | 2.36/1.48 | 0.83/2.07 | 1.90 |
| SLC2A1 | 1.96/1.31 | 0.53/1.85 | 1.77 |
| P4HA1 | −4.88/2.04 | −6.35/1.16 | 1.37 |
| LOX | −1.09/1.68 | −2.43/1.96 | 1.92 |
| C3orf28 | −0.64/0.71 | −1.29/0.47 | 0.51 |
| BNIP3L | −0.46/0.28 | −1.09/0.53 | 0.49 |
| BNIP3 | −0.63/0.44 | −1.52/1.40 | 1.24 |
| EGLN3 | −0.55/2.08 | −1.56/1.46 | 1.56 |
| PDK1 | −1.71/0.58 | −2.31/0.47 | 0.48 |
| PFKFB3 | 0.46/0.95 | −0.24/1.18 | 1.14 |
| KCTD11 | −2.08/2.34 | −3.13/1.78 | 1.85 |
| ALDOA | −0.67/1.17 | −1.55/1.52 | 1.46 |

Thus, in general, the oxygen status of the cancer is characterised on the basis of two D-values, here designated as $D_{more}$ and $D_{less}$. If $D_{more}$ is the lowest, then the cancer is classified as 'more-hypoc', or low oxygen/hypoxic, and if $D_{less}$ is the lowest, then the cancer is classified as 'less-hypoxic', or high oxygen/non-hypoxic. The D-value is calculated according to the general formula:

$$D_i = \sum_m \frac{(y_m - z_{im})^2}{W_m},$$

where m refers to the mth gene out of the 1-15 genes, i is the group (more or less hypoxic), z is the mean of the group (such as indicated in for example table 2 and 3), W is the calculated common variance (also cf. table 2 and 3, for example) and y is the gene expression (such as the correlated gene expression) of the classified sample.

The number of genes measured can be any number and/or combination, but preferably at least 5, and even more preferred, the transcription of all 15 genes of the present invention (cf. table 2 or table 3) are measured. If one or more of the 15 genes is not measured, then the formulae are reduced accordingly. Thus, in the specific embodiment of table 3, if only ADM, ANKRD37, P4H4 and NDRG1 are measured, then the formulae for $D_{more}$ and $D_{less}$ are:

$$D_{more} = \frac{(y_{ADM} - (-0.75))^2}{1.40} + \frac{(y_{ANKRD37} - (-4.16))^2}{0.70} +$$
$$\frac{(y_{P4HA2} - (-2.71))^2}{0.90} + \frac{(y_{NDRG1} - (2.36))^2}{1.90}$$

$$D_{less} = \frac{(y_{ADM} - (-2.35))^2}{1.40} + \frac{(y_{ANKRD37} - (-5.65))^2}{0.70} +$$
$$\frac{(y_{P4HA2} - (-4.21))^2}{0.90} + \frac{(y_{NDRG1} - (0.83))^2}{1.90}$$

The mean ΔCt-value and common variance for each may, however, be chosen from each of the intervals identified in table 2.

So based on the definitions above, the oxygen status of a cancer is classified as low oxygen/(more) hypoxic if $D_{more}$ calculated on the basis of the ΔCt and variance values provided in tables 2 and/or 3 for the "more hypoxic group" are lower than the corresponding $D_{less}$ calculated on the basis of the corresponding ΔCt and variance values of tables 2 and 3 for the "less hypoxis group".

Conversely, the oxygen status of a cancer is classified as high oxygen/(less) hypoxic if $D_{less}$ calculated on the basis of the ΔCt and variance values provided in tables 2 and/or 3 for the "less hypoxic group" is lower than the corresponding $D_{more}$ calculated on the basis of the corresponding ΔCt and variance values of tables 2 and 3 for the "more hypoxis group".

Treatment

As described elsewhere herein tumours with low oxygen levels are often resistant to radiotherapy. The resistance involves a lack of oxygen to react with free radicals released during irradiation thereby reducing the formation of damaging compounds inside the tumour. Consequently, treatment of individuals suffering from cancer, such as planocellular cancer and/or squamous cellular cancer, wherein the oxygen level is classified as low ('more' hypoxic) with hypoxia-modifying agents alone or in combination with radiation will improve the therapeutic outcome. Since treatment with hypoxia-modifying agents has a number of side effects such as nausea, vomiting and for example neuropathy, it is desired to select the individuals having contracted cancer, such as planocellular cancer and/or squamous cellular cancer, who will to benefit from treatment with a hypoxia-modifying agent. Consequently, individuals suffering from a cancer, such as planocellular cancer and/or squamous cellular cancer, who will not benefit from treatment with a hypoxia-modifying agent should not be treated with a hypoxia-modifying agent and thus not be subjected to the serious side effects of such hypoxia-modifying agent.

Thus, in one aspect the present invention relates to a method for the amelioration and/or treatment of a cancer, such as planocellular cancer and/or squamous cellular cancer, in an individual in need thereof, said method comprising the steps of a. obtaining or providing a sample of a cancer, such as planocellular cancer and/or squamous cellular cancer from an individual b. performing the method as disclosed in the present invention, thereby determining the oxygen status of said cancer, such as planocellular cancer and/or squamous cellular cancer, c. selecting individuals with high degree of hypoxia d. administering a hypoxia-modifying agent in a therapeutically effective amount in said individuals, thereby ameliorating and/or treating said cancer, such as planocellular cancer and/or squamous cellular cancer, in said individual in need thereof.

It is within the scope of the method of treatment that the transcriptional level of genes is determined as described in the section 'Method of determining oxygen status'.

In one embodiment the treatment comprises the further step of subjecting the individual to radiation under conditions as described in the section 'Radiation therapy'. It is appreciated that the radiation therapy occurs as one or more fractions. Thus, the hypoxia-modifying agent is administered prior to or simultaneously with the radiation therapy. In a preferred embodiment the administration is prior to radiation therapy.

A second aspect of the invention relates to the treatment of individuals having contracted cancer, such as planocellular cancer and/or squamous cellular cancer, wherein the cancer has a low degree of hypoxia. Such individuals will not benefit from treatment, wherein hypoxia-modifying agents are administered in connection with radiation therapy. The side effects of the hypoxia-modifying agent are severe, leading to nausea, vomiting etc. which makes the individual less able to withstand the radiation therapy needed. Thus the present invention pertains to a method for amelioration and/or treatment of low degree hypoxic cancer, such as planocellular cancer and/or squamous cellular cancer, in an individual in need thereof, said method comprising the steps of a. obtaining or providing a sample of a cancer, such as planocellular cancer and/or squamous cellular cancer, from an individual b. performing the method as disclosed herein, thereby determining the oxygen status of cancer c. selecting individuals with low degree-hypoxic cancer, such as planocellular cancer and/or squamous cellular cancer, d. subjecting said individuals to radiation therapy thereby ameliorating and/or treating said low degree hypoxic cancer in said individual in need thereof.

The invention also in one aspect provides a method for selecting an individuals having a cancer, which does not need treatment with a hypoxia modifying agent prior or simultaneous to radiation therapy, said method comprising i) providing a sample of a cancer from said individual ii) determining the oxygen status of said cancer by a method of the present invention, iii) selecting individuals having a cancer characterized by high oxygen status, and iv) subjecting said individuals having a cancer characterized by high oxygen status to radiation therapy without administering a hypoxia-modifying agent.

The term "treatment", as used anywhere herein comprises any type of therapy, which aims at terminating, ameliorating and/or reducing a clinical condition as described herein. Thus, "treatment," "treating," and the like, as used herein, refer to obtaining a desired pharmacologic and/or physiologic effect, covering any treatment of a pathological condition or disorder in a mammal, including a human. The effect may be therapeutic in terms of a partial or complete cure for a disorder and/or adverse affect attributable to the disorder. That is, "treatment" includes (1) inhibiting the disorder, such as arresting its development, (2) stopping or terminating the disorder or at least symptoms associated therewith, so that the host no longer suffers from the disorder or its symptoms, such as causing regression of the disorder or its symptoms, for example, by restoring or repairing a lost, missing or defective function, or stimulating an inefficient process, or (3) relieving, alleviating, or ameliorating the disorder, or symptoms associated therewith, where ameliorating is used in a broad sense to refer to at least a reduction in the magnitude of a parameter, such as the cancer, such as planocellular cancer and/or squamous cellular cancer, of the present invention, wherein the oxygen level of the tumour is low.

Hypoxia-Modifying Agent

The present invention in one aspect relates to a hypoxia-modifying agent for for use in the treatment of a cancer, which has been determined to be hypoxic by a method of the present invention, and optionally in conjunction with radiotherapy. Thus, the invention in one aspect provides a hypoxia-modifying agent for for use in the treatment of a cancer in an individual, wherein in said cancer i) the transcriptional expression level of ADM (SEQ ID NO:1) or a variant at least 95% identical thereto, ii) correlated to the expression of at least one reference gene, iii) corresponds to the correlated transcriptional expression level of ADM (SEQ ID NO: 1) or a variant at least 95% identical thereto of a predetermined reference sample comprising cancer cells characterized by a low oxygen level.

In a preferred embodiment of the hypoxia-modifying agent of the invention, the cancer is found to be hypoxic by a method of the present invention, as defined herein above. Thus, in such a preferred embodiment, in the cancer, for which the hypoxia-modifying agent is claimed for use in treating, i) the transcriptional expression level of ADM or a variant at least 95% identical thereto and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes, ii) correlated to at least one reference gene, iii) corresponds to the correlated transcriptional expression level of ADM (SEQ ID NO: 1) or a variant at least 95% identical thereto and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes of a predetermined reference sample comprising cancer cells characterized by a low oxygen level, and iv) differs from the correlated transcriptional expression level of ADM (SEQ ID NO: 1) or a variant at least 95% identical thereto and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes of a predetermined reference sample comprising cancer cells characterized by a high oxygen level.

In a particular preferred embodiment, the correlated transcriptional expression level of ADM or a variant thereof and optionally said one or more additional genes or variants are more similar to the correlated transcriptional expression level of ADM or variant thereof and optionally said one or more additional genes or variants thereof of a predetermined reference sample comprising cancer cells characterized by a low oxygen level than to the correlated transcriptional expression level of ADM or variant thereof and optionally said one or more additional genes or variants thereof of a predetermined reference sample comprising cancer cells characterized by a high oxygen level.

The at least one additional gene, the predetermined reference sample, the reference gene, the sample, the cancer, and evaluation of oxygen status and/or transcriptional expression level is determined as defined elsewhere herein.

The hypoxia-modifying agent of the present invention is an agent that aids in providing a less hypoxic environment in the tumour. The hypoxia-modifying agent of the present invention are thus compounds that increase the oxygen level of the tumour, mimic the effect of oxygen in the radiochemical process that occurs during radiation therapy, or hypoxic cytotoxins that destroy hypoxic cells.

In one embodiment the hypoxia-modifying agent is selected from the group consisting of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidin kinase inhibitors, CA4O OXi4503, DMXAA, nimorazole, MISO and DORA.

It is appreciated that the hypoxia-modifying agent may be selected from any of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidin kinase inhibitors, CA4O OXi4503, DMXAA, nimorazole, MISO or DORA.

The hypoxia-modifying agent of the present invention may thus be compounds that increase the oxygen level of the tumour delivered in the blood. The hypoxia-modifying agent may thus in one embodiment be agents for high oxygen gas breathing, for example HBO (hyperbaric oxygen) and/or Carbogen (mixture of carbon dioxide and oxygen gas) or ARCON (nicotinamide in combination with carbogen). The hypoxia-modifying agent of the present invention acting by increasing the oxygen level is altering the ability of haemoglobin of the individual in need to carry more oxygen, such agents are blood transfusion, EPO (erythropoietin), 2,3-DPG, 2,3-diphosphoglycerate, also known as 2,3-BPG, 2,3-bisphosphoglycerate (an important allosteric factor controlling the haemoglobin-oxygen dissociation curve) or Nicotinamide (prevents/reduces transient changes in blood flow).

In another embodiment the hypoxia-modifying agent is an agent that preferentially kills hypoxic cells. One agent is hyperthermia that aids in the body's ability to deal with radiation-induced DNA damage. Other agents agent that preferentially kills hypoxic cells are MMC (mitomycin C), TPZ (tirapazamine), AQ4N (banoxantrone), PR-104, LCQ-1, RH1, or anti-carbonic anhydrase IX (CAIX) drugs such as Indisulam, sulfonamides, sulfamates, and sulfamides or anaerobic bacteria such as oncolytic bacteria that sporulate in hypoxic tumours, e.g. *Clostridium*, but also genetically modified non-pathogenic (e.g. *Bifidobacterium*) or toxicity-attenuated (e.g. *Clostridium*), for example expressing cytosine deaminase (from *E. coli*)+5-fluorouracil (5FU).

In a particular embodiment the hypoxia-modifying agent is TPZ tirapazamine.

In another embodiment of the present invention the hypoxia-modifying agent is a drug targeting angiogenesis inhibitor such as avastin, DC101 or thymidin kinase inhibitors, or drugs targeting vascular disruptive events such as CA4O (combretastatin), OXi4503, or DMXAA In a further embodiment of the present invention the hypoxia-modifying agent is an agent that mimics the effect of oxygen during radiation therapy such as NIM (nimorazole, also known as Naxogin or Nimoral, see below), MISO (misonidazole) or DORA (doranidazole).

In one preferred embodiment of the present invention' the hypoxia-modifying agent is Nimorazole known as described below.

Nimorazole: 4-[2-(5-nitroimidazol-1-yl)ethyl]morpholine, 1-(2-N-Morpholinylethyl)-5-nitroimidazole, 1-(.beta.-Morpholinoethyl)-5-nitroimidazole, 1-(beta-Morpholinoethyl)-5-nitroimidazole, 1-(N-p-Ethylmorpholine)-5-nitroimidazole, 4-[2-(5-nitroimidazol-1-yl)ethyl]

morpholine, 4-(2-(5-Nitroimidazol-1-yl)ethyl)morpholine, 4-(2-(5-Nitroimidazol-1-yl)ethyl)-morpholine, 4-[2-(5-Nitroimidazol-1-yl)ethyl]morpholine, 6506-37-2, Acterol, Acterol forte, BRN 0533758, C9H14N403, D07352, EINECS 229-394-4, Esclama, K 1900, K-1900, LS-93226, Morpholine, 4-(2-(5-nitro-1H-imidazol-1-yl)ethyl)-, Morpholine, 4-[2-(5-nitro-1H-imidazol-1-yl)ethyl]-, Morpholine, 4-(2-(5-nitro-1H-imidazol-1-yl)ethyl)-(9Cl), Morpholine, 4-(2-(5-nitroimidazol-1-yl)ethyl)-, Morpholine, 4-[2-(5-nitroimidazol-1-yl)ethyl]-, N-2-Morpholinoethyl-5-nitroimidazole, Naxofem, Naxogin, Naxogin (TN), Nimorazol, Nimorazole, Nimorazole [BAN:INN], Nimorazole (INN), Nimorazol [INN-Spanish], Nimorazolo [DCIT], Nimorazolum [INN-Latin], Nitrimidazine, NSC107524, NSC 107524, Nulogyl, Sirledi, WLN: T6N DOTJ A2-AT5N CNJ ENW.

In a particular preferred embodiment of the present invention the hypoxia-modifying agent is Naxogin.

Radiation Therapy

The present invention in one aspect relates to an electromagnetic radiation source for use in the treatment of cancer, which has been determined to be non-hypoxic by a method of the present invention. Thus, the invention in one aspect provides an electromagnetic radiation source for use in the treatment of a cancer in an individual, wherein in said cancer i) the transcriptional expression level of ADM (SEQ ID NO:1) or a variant at least 95% identical thereto, ii) correlated to the expression of at least one reference gene, iii) corresponds to the correlated transcriptional expression level of ADM (SEQ ID NO: 1) or a variant at least 95% identical thereto of a predetermined reference sample comprising cancer cells characterized by a high oxygen level An electromagnetic radiation source of the present invention includes any means for generating electromagnetic radiation such as gammarays, X rays and/or any other electromagnetic radiation, which is suitable for treatment of cancer by radiation therapy.

In a preferred embodiment of the electromagnetic radiation source of the invention, the cancer is found to be non-hypoxic by a method of the present invention, as defined herein above. Thus, in such a preferred embodiment, in the cancer, for which the electromagnetic radiation source is claimed for use in treating, i) the transcriptional expression level of ADM or a variant at least 95% identical thereto and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes, ii) correlated to at least one reference gene, iii) corresponds to the correlated transcriptional expression level of ADM (SEQ ID NO: 1) or a variant at least 95% identical thereto and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes of a predetermined reference sample comprising cancer cells characterized by a high oxygen level, and iv) differs from the correlated transcriptional expression level of ADM (SEQ ID NO: 1) or a variant at least 95% identical thereto and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes of a predetermined reference sample comprising cancer cells characterized by a low oxygen level.

In a particular preferred embodiment, the correlated transcriptional expression level of ADM or a variant thereof and optionally said one or more additional genes or variants are more similar to the correlated transcriptional expression level of ADM or variant thereof and optionally said one or more additional genes or variants thereof of a predetermined reference sample comprising cancer cells characterized by a high oxygen level than to the correlated transcriptional expression level of ADM or variant thereof and optionally said one or more additional genes or variants thereof of a predetermined reference sample comprising cancer cells characterized by a low oxygen level.

The at least one additional gene, the predetermined reference sample, the reference gene, the sample, the cancer, and evaluation of oxygen status and/or transcriptional expression level is determined as defined elsewhere herein.

The present invention relates in one embodiment to the combination of administration of a hypoxia-modifying agent and radiation therapy.

Radiation therapy, also denoted radiotherapy and/or radiation oncology, and sometimes abbreviated to XRT, according to the present invention is the medical use of ionizing radiation (IR) as part of cancer treatment to control malignant cells (not to be confused with radiology, the use of radiation in medical imaging and diagnosis). Radiation therapy may be used for curative or adjuvant treatment. It is used as palliative treatment (where cure is not possible and the aim is for local disease control or symptomatic relief) or as therapeutic treatment (where the therapy has survival benefit and it can be curative).

Radiotherapy may be used for the treatment of tumours (benign as well as malignant), and may be used as a primary or adjuvant modality. It is also common to combine radiotherapy with surgery, cytotoxic drugs, hormone therapy or some mixture of the three. Most common tumour types can be treated with radiotherapy in some way. The precise treatment intent (curative, adjuvant, neoadjuvant, therapeutic, or palliative) will depend on the tumour type, location, and stage, as well as the general health of the patient.

To spare normal tissues (such as skin or organs which radiation must pass through in order to treat the tumour), shaped radiation beams may in the present invention be aimed from several angles of exposure to intersect at the tumour, providing a much larger absorbed dose there than in the surrounding, healthy tissue.

Radiation therapy works by damaging the DNA of cells. The damage is caused by a photon, electron, proton, neutron, or ion beam directly or indirectly ionizing the atoms which make up the DNA chain. Indirect ionization happens as a result of the ionization of water, forming free radicals, notably hydroxyl radicals, which then damage the DNA. In the most common forms of radiation therapy, most of the radiation effect is through free radicals. Because cells have mechanisms for repairing DNA damage, breaking the DNA on both strands proves to be the most significant technique in modifying cell characteristics. Because cancer cells generally are undifferentiated and stem cell-like, they reproduce more, and have a diminished ability to repair sub-lethal damage compared to most healthy differentiated cells. The DNA damage is inherited through cell division, accumulating damage to the cancer cells, causing them to die or reproduce more slowly.

In the present invention the amount of radiation used in radiation therapy is measured in gray (Gy), and varies depending on the type and stage of cancer being treated. In one embodiment of the present invention radiation therapy is given for curative cases, and the typical dose for a solid epithelial tumour ranges from 60 to 80 Gy in 1.8-2 Gy fractions, such as about 2 Gy.

In another embodiment of the present invention radiation therapy is administered for preventative (adjuvant) purposes in which case the doses are typically around 45-60 Gy in 1.8-2 Gy fractions, such as about 2 Gy (for cancer, such as planocellular cancer and/or squamous cellular cancers, for example Head and Neck cancers.

Many other factors are considered by radiation oncologists when selecting a dose, including whether the patient is receiving cytotoxic drugs, patient comorbidities, whether radiation therapy is being administered before or after surgery, and the degree of success of surgery.

In the present invention the amount of radiation used is preferably in the ranges 60-80 Gy, such as 60-70 Gy, more preferably 40-60 Gy, such as 40-50 Gy, more preferably 20-40 Gy, such as 20-30 Gy, more preferably 1-20 Gy, such as 1-10 Gy, more preferably 1-2 Gy.

Depending on the radiation delivery method, several angles or sources may be used to sum to the total necessary dose. The total dose may be fractionated (spread out over time) for several important reasons. Fractionation allows normal cells time to recover, while tumour cells are generally less efficient in repair between fractions. Fractionation may also allow tumour cells that were in a relatively radio-resistant phase of the cell cycle during one treatment to cycle into a sensitive phase of the cycle before the next fraction is given. Similarly, tumour cells that were chronically or acutely hypoxic (and therefore more radioresistant) may reoxygenate between fractions, improving the tumour cell kill. In one embodiment of the present invention, two fractions of radiation therapy per day are used near the end of a course of treatment. This schedule, known as a concomitant boost regimen or hyperfractionation, is used on tumours that regenerate more quickly when they are smaller. In particular, tumours in the head-and-neck demonstrate this behavior.

In the present invention the fractionation schedule may preferably consists of 1.8 to 2 Gy per day, for 3 to 7, preferably five days a week, more preferably 1.5 to 1.8 Gy per day, for 3 to 7, preferably five days a week.

In one embodiment of the present invention a hypoxia-modifying agent, as described in the section "hypoxia-modifying agent", is administered immediately prior to the administration of radiation therapy, as described here above. Immediately prior to radiation therapy as used herein, unless otherwise indicated, denotes an administration within 5 days of initiation of radiation therapy, more preferably with 4 days, such as within 3 days, more preferably within 2 days, such as with in 1 day, more preferably within 20 hours, such as within 10 hours, more preferably within 5 hours, more preferably within 4.5 hours, such as with in 4 hours, more preferably within 3.5 hours, such as within 3 hours, more preferably within 2.5 hours, such as within 2 hours, more preferably within 1.5 hours, such as within 1 hour, more preferably within 0.5 hour, such as within 15 minutes, more preferably within 10 minutes, such as within 5 minutes of radiation therapy. In a preferred embodiment the hypoxia-modifying agent is administered within 1.5 hour of initiation of radiation therapy.

Additional Compound and Combination Treatment

In the methods for treatment of the present invention, uses of a hypoxia-modifying agent and pharmaceutical composition, an additional compound may be used in combination treatment in the form of one or more other anti-proliferative or anti-neoplastic agents.

Such anti-proliferative agents include, but are not limited to aromatase inhibitors; antiestrogens; topoisomerase I inhibitors; topoisomerase II inhibitors; microtubule active agents; alkylating agents; histone deacetylase inhibitors; compounds which induce cell differentiation processes; cyclooxygenase inhibitors; MMP inhibitors; mTOR inhibitors; antineoplastic antimetabolites; platin compounds; compounds targeting/decreasing a protein or lipid kinase activity and further anti-angiogenic compounds; compounds which target, decrease or inhibit the activity of a protein or lipid phosphatase; gonadorelin agonists; anti-androgens; angiostatic steroids; methionine aminopeptidase inhibitors; bisphosphonates; biological response modifiers; antiproliferative antibodies; heparanase inhibitors; inhibitors of Ras oncogenic isoforms; telomerase inhibitors; proteasome inhibitors.

The additional compound of the present invention may also be used as a radiosensitizer, including, for example, the treatment of tumours which exhibit poor sensitivity to radiotherapy.

A radiosensitizing drug used in the present invention is a drug which makes tumours more sensitive to radiation therapy. Such radiosensitizing drugs include but are not limited to Cisplatin or for example Cetuximab. In one embodiment of the present invention the hypoxia-modifying agent is administered in combination with Cisplatin and/or Cetuximab. The hypoxia-modifying agent and the radiosensitizing drug may be administered simultaneously or sequential as a combined medicament or as discrete entities. In one embodiment the radiosensitizing drug and the hypoxia-modifying agent is formulated as a combined medicament.

By the term "combination", is meant either a fixed combination in one dosage unit form, or a kit of parts for the combined administration where a compound of the present invention and a combination partner may be administered independently at the same time or separately within time intervals that especially allow that the combination partners show a cooperative, e.g., synergistic, effect, or any combination thereof.

Pharmaceutical Composition, Uses and Administration

Pharmaceutical Composition

In one aspect of this invention, there is provided a pharmaceutical composition comprising, a hypoxia-modifying agent or a pharmaceutically acceptable salt thereof for treatment of cancer, such as planocellular cancer and/or squamous cellular cancer, in an individual in need thereof, wherein said cancer is characterised as being 'more' hypoxic i.e. having a low oxygen status as defined elsewhere herein and optionally one or more pharmaceutically acceptable carriers or diluents. Thus, in one aspect the present invention relates to a pharmaceutical composition comprising a hypoxia-modifying agent or a pharmaceutically acceptable salt thereof for treatment of cancer, such as planocellular cancer and/or squamous cellular cancer, in an individual in need thereof, wherein said cancer, such as planocellular cancer and/or squamous cellular cancer, is characterised as having a high degree of cellular hypoxia, wherein the transcriptional expression level of at least one gene selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and/or variants thereof is determined and correlated to a cut-off value.

For example the transcriptional expression level of at least 2, preferably at least 3, more preferably at least 4, even more preferably at least 5 genes selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2), and/or variants thereof may be used in the method.

In another embodiment of the present invention the transcriptional expression level of at least C3orf28 (SEQ ID NO.: 6), EGLN3 (SEQ ID NO.: 7), KCTD11 (SEQ ID NO.: 8), PDK1 (SEQ ID NO.: 13) and PFKFB3 (SEQ ID NO.: 14) or variants thereof.

Similarly the present invention in another aspect relates to the use of a hypoxia-modifying agent for the manufacture of a medicament for treatment of cancer, such as planocellular cancer and/or squamous cellular cancer, in an individual in need thereof, wherein said cancer is characterised as having a high degree of cellular hypoxia, wherein a transcriptional expression level of at least one gene selected from the group consisting of ADM (SEQ ID No:1), and/or optionally ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and/or variants thereof is determined and correlated to a cut-off value.

It is appreciated that the method for determining the oxygen status of a cancer, such as planocellular cancer and/or squamous cellular cancer, may be one method of establishing whether a cancer has a high degree of hypoxia, which is described in section 'method for determining oxygen status'.

The hypoxia-modifying agent of the pharmaceutical composition may be selected from a number of agents that are listed in the section 'hypoxia-modifying agent'. One preferred hypoxia-modifying agent is Nimorazole is (4-[2-(5-nitro-1H-imidazol-1-yl)ethyl]morpholine).

The hypoxia-modifying agent of the invention may be administered alone or in combination with pharmaceutically acceptable carriers, diluents or excipients, in either single or multiple doses. Suitable pharmaceutical acceptable carriers, diluents and excipients include inert solid diluents or fillers, sterile aqueous solutions and various organic solvents.

The pharmaceutical compositions according to the invention may be formulated with pharmaceutically acceptable carriers or diluents as well as any other known adjuvants and excipients in accordance with conventional techniques such as those disclosed in Remington: The Science and Practice of Pharmacy, 21st Edition, 2000, Lippincott Williams & Wilkins.

The pharmaceutical compositions of the present invention formed by combining the hypoxia-modifying agent, or a pharmaceutically acceptable salt, solvate or prodrug thereof, with one or more hydrophobic amino acids and pharmaceutical acceptable carriers, diluents or excipients can be readily administered in a variety of dosage forms such as tablets, powders, lozenges, syrups, suppositories, injectable solutions and the like. In powders, the carrier is a finely divided solid such as talc or starch which is in a mixture with the finely divided active component. In tablets, the active component is mixed with the carrier having the necessary binding properties in suitable proportions and compacted in the shape and size desired.

Suitable solid carriers include, but are not limited to, lactose, terra alba, sucrose, cyclodextrins (such as hydroxypropyl-β-cyclodextrin, HPCD), talc, gelatine, agar, pectin, acacia, magnesium stearate, stearic acid or lower alkyl ethers of cellulose.

Examples of liquid carriers include, but are not limited to, syrup, peanut oil, olive oil, phospholipids, fatty acids, fatty acid amines, polyoxyethylene, polysorbates (such as Tween-20 or Tween-80), Cremophor EL or water. Similarly, the carrier or diluent may include any sustained release material known in the art, such as glyceryl monostearate or glyceryl distearate, alone or mixed with a wax. Also contemplated are nano-formulations, such as nano-emulsion or nano-dispersions. In a preferred embodiment of the invention the excipients used in the pharmaceutical formulation conforms to the "Generally recognized as Safe" GRAS listing provided by the FDA.

The pharmaceutical compositions may be specifically formulated for administration by any suitable route such as the oral, parenteral (including subcutaneous, intramuscular, intrathecal, intravenous and intradermal), intravitael and intranasal route. The preferred route of administration in the present invention is oral. It will be appreciated that the preferred route will depend on the general condition and age of the individual to be treated and the nature of the condition to be treated.

Pharmaceutical compositions for oral administration include solid dosage forms such as capsules, tablets, dragees, pills, lozenges, powders and granules. Where appropriate, they can be prepared with coatings such as enteric coatings or they can be formulated so as to provide controlled release of the active ingredient such as sustained or prolonged release according to methods well known in the art.

For oral administration in the form of a tablet or capsule, a hypoxia-modifying agent of the present invention may suitably be combined with an oral, non-toxic, pharmaceutically acceptable carrier such as ethanol, glycerol, water or the like. Furthermore, suitable binders, lubricants, disintegrating agents, flavouring agents and colourants may be added to the mixture, as appropriate. Suitable binders include, e.g., lactose, glucose, starch, gelatin, acacia gum, tragacanth gum, sodium alginate, carboxymethylcellulose, polyethylene glycol, waxes or the like. Lubricants include, e.g., sodium oleate, sodium stearate, magnesium stearate, sodium benzoate, sodium acetate, sodium chloride or the like. Disintegrating agents include, e.g., starch, methyl cellulose, agar, bentonite, xanthan gum, sodium starch glycolate, crospovidone, croscarmellose sodium or the like. Additional excipients for capsules include macrogols or lipids. For the preparation of solid compositions such as tablets, the hypoxia-modifying agent is mixed with one or more excipients, such as the ones described above, and other pharmaceutical diluents such as water to make a solid preformulation composition containing a homogenous mixture of a compound of the present invention. The term "homogenous" is understood to mean that the compound of the present invention is dispersed evenly throughout the composition so that the composition may readily be subdivided into equally effective unit dosage forms such as tablets or capsules.

Liquid formulations for either oral or parenteral administration of the compound of the invention include, e.g., aqueous solutions, syrups, elixirs, aqueous or oil suspensions and emulsion with edible oils such as cottonseed oil, sesame oil, coconut oil or peanut oil. Suitable dispersing or suspending agents for aqueous suspensions include synthetic or natural gums such as tragacanth, alginate, acacia, dextran, sodium carboxymethylcellulose, gelatin, methylcellulose or polyvinylpyrolidone. Pharmaceutical compositions for parenteral administration include sterile aqueous and non-aqueous injectable solutions, dispersions, suspensions or emulsions as well as sterile powders to be reconstituted in sterile injectable solutions or dispersions prior to use. For parenteral administration, solutions containing a protein of interest of this invention or a pharmaceutically acceptable salt, solvate or prodrug thereof in sesame or peanut oil, aqueous propylene glycol, or in sterile aqueous solution may be employed. Such aqueous solutions should be suitably buffered if necessary and the liquid diluent first rendered isotonic with sufficient saline or glucose. These particular aqueous solutions are especially suitable for intravenous, intramuscular, subcutaneous and intraperitoneal administration. The oily solutions are suitable for intra-articular, intra-muscular and subcutaneous injection purposes. The preparation of all these solutions under sterile conditions is readily accomplished by standard pharmaceutical techniques well known to those skilled in the art. Depot injectable formulations are also contemplated as being within the scope of the present invention.

In addition to the aforementioned ingredients, the formulations of a compound of the present invention may include one or more additional ingredients such as diluents, buffers, flavouring agents, colourant, surface active agents, thickeners, preservatives, e.g. methyl hydroxybenzoate (including anti-oxidants), emulsifying agents and the like.

A suitable dosage of the pharmaceutical composition of the invention will depend on the age and condition of the patient, the severity of the disease to be treated and other factors well known to the practicing physician. The pharmaceutical composition may be administered for example either orally according to different dosing schedules, e.g. daily or with intervals, such as weekly intervals. In general a single dose will be in the range from When the hypoxia-modifying agent is nimorazole and administered orally the pharmaceutical composition may be administered prior to the first daily radiation treatment in the range of 1 to 2500 mg/square meter of body surface, preferably from about 100 to 2000 mg/square meter of body surface, more preferably from about 500 to 1800 mg/square meter of body surface, more preferably between 1000 to 1500 mg square meter of body surface, and most preferably between 1100 to 1400 mg/square meter of body surface, preferably 1200 mg/square meter of body surface.

When the hypoxia-modifying agent is nimorazole and administered orally the pharmaceutical composition may be administered prior to a subsequent daily radiation treatment in the range of 1 to 2500 mg/square meter of body surface, preferably from about 100 to 2000 mg/square meter of body surface, more preferably from about 500 to 1800 mg/square meter of body surface, more preferably between 800 to 1500 mg square meter of body surface, and most preferably between 900 to 1200 mg/square meter of body surface, preferably 1000 mg/square meter of body surface.

The hypoxia-modifying agent of this invention is generally utilized as the free substance or as a pharmaceutically acceptable salt or ester thereof. One example is an acid addition salt of a compound having the utility of a free base. Physiologically acceptable salts of a compound with a hydroxy group include the anion of said compound in combination with a suitable cation such as sodium or ammonium ion.

The hypoxia-modifying agent of the invention may also be formulated in a pharmaceutical composition comprising one or more further active substances alone, or in combination with pharmaceutically acceptable carriers, diluents, or excipients in either single or multiple doses. The suitable pharmaceutical acceptable carriers, diluents and excipients are as described herein above, and the one or more further active substances may be any active substances, or preferably an active substance as described in the section "combination treatment" herein below.

Administration may be via any route known to be effective by the physician of ordinary skill. Oral administration is preferred. Extended duration may be obtained by selecting appropriate macromolecules, for example, polyesters, polyamino acids, polyvinylpyrrolidone, ethylenevinyl acetate, methylcellulose, carboxymethylcellulose, or protamine sulfate, and by selecting the concentration of macromolecules, as well as the methods of incorporation, in order to prolong release. Another possible method to extend the duration of action by controlled release preparations is to incorporate an active compound used in the present invention into particles of a polymeric material such as polyesters, polyamino acids, hydrogels, poly (lactic acid) or ethylene vinylacetate copolymers. Alternatively, instead of incorporating a compound into these polymeric particles, it is possible to entrap a compound used in the present invention in microcapsules prepared, for example, by coacervation techniques or by interfacial polymerization, for example, hydroxymethylcellulose or gelatin-microcapsules, respectively, or in colloidal drug delivery systems, for example, liposomes, albumin microspheres, microemulsions, nanoparticles, and nanocapsules, or in macroemulsions. Such teachings are disclosed in Remington's Pharmaceutical Sciences (1980).

Treatment with Radiation Therapy without Administering a Hypoxia-Modifying Agent The invention in one aspect relates to a method for selecting individuals having a cancer, which does not need treatment with a hypoxia modifying agent prior or simultaneous to radiation therapy, said method comprising
  i) providing a sample of a cancer from said individual
  ii) determining the oxygen status of said cancer by a method of the invention,
  iii) selecting individuals having a cancer characterized by high oxygen status, and
  iv) subjecting said individuals having a cancer characterized by high oxygen status to radiation therapy without administering a hypoxia-modifying agent.

Prognosis

In one particular aspect, the present invention provides a method for determining the prognosis of a cancer of an individual, wherein the oxygen status of the cancer is determined by a method as defined herein above; i.e. a method for determining the oxygen status of a cancer of an individual comprising i) in a sample comprising cells of said cancer ii) determining the transcriptional expression level of the ADM gene (SEQ ID NO:1) or a variant at least 95% identical thereto, iii) correlating said transcriptional expression level of the ADM gene to the expression level of at least one reference gene, and iv) evaluating the oxygen status of said cancer by comparing the correlated transcriptional expression level of iii) with a predetermined correlated transcriptional expression level of ADM.

In one preferred embodiment, the method comprises i) in a sample comprising cells of said cancer ii) determining the transcriptional expression level ADM and at least one additional gene selected from the group consisting of ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants at least 95% identical to any one of said genes, iii) correlating said transcriptional expression level of the ADM gene and said at least one additional gene to the expression level of at least one reference gene, and iv) evaluating the oxygen status of said cancer by comparing the correlated transcriptional expression level of iii) with a predetermined correlated transcriptional expression level of ADM and said at least one additional gene.

According to the prognostic method of the invention, a cancer characterized by low oxygen status is associated with poor prognosis. Thus, a poor prognosis is associated with cancers, wherein the correlated transcriptional expression level of ADM or a variant thereof and optionally above-said one or more additional genes or variants are more similar to the correlated transcriptional expression level of ADM or variant thereof and optionally said one or more additional genes or variants thereof of a predetermined reference sample comprising cancer cells characterized by a low oxygen level than to the correlated transcriptional expression level of ADM or variant thereof and optionally said one or more additional genes or variants thereof of a predetermined reference sample comprising cancer cells characterized by a high oxygen level.

Cancers associated with poos prognosis will for example show a stronger tendency to create distant metastases. Also, such cancer with poor prognosis would often show a reduced therapeutic response. Thus, generally, cancers with poor prognosis would tend to be more aggressive tumours than other cancers. Thus, for such cancers for which the prognosis has been found to be poorer according to the method of the invention, the therapeutic treatment should preferably be stronger, and for example include systemic chemotherapeutic treatment and/or other anti-cancer therapies, for example in addition to surgical treatments.

EXAMPLES

Below are non-limiting examples of the amount of the various components of the compositions and formulas of the present invention. It is appreciated that the compositions and formulas of the present invention may comprise the components in amounts that differ from the examples herein below. The examples below may thus be regarded as preferred embodiments of the present invention.

Example 1

Gene Classifier Predicts for Hypoxic Modification of Radiotherapy in Head and Neck Cancer This example illustrates how to generate a method for characterizing the hypoxic status of a tumour on the basis of gene expression quantification from its biopsy, and furthermore individualize the treatment in accordance to this characterization. Thus, the experimental plan involved identifying specific hypoxia-responsive genes responding with a significant increase in expression correlating to a radiobiological relevant oxygen level (<10 mm Hg), that could identify patients having benefit from hypoxic modification of radiotherapy. Such "hypoxia-regulated genes" have previously been suggested in the literature, but none of the developed hypoxia gene expression signatures have yet shown to be predictive and consequently implemented in the clinic.

Hypoxia-responsive genes are known from microarray-analysis of gene expression in more cell lines of human squamous cell carcinoma, where both pH and oxygen tension were taken into account. 29 genes being upregulated under hypoxic conditions and furthermore being independent of extracellular pH-fluctuations have been suggested (FIG. 1a). In addition we chose to include the gene CA9, which has frequently been associated to hypoxia in the literature (Table 4). To confirm the in vivo hypoxia-specificity of these genes, subcutaneous xenograft tumours in nude mice were established from more of the cell lines that were used in the in vitro experiments. Before excision of the evolved tumour, mice were administered with the hypoxia tracer [$^{18}$F]-FAZA which allowed ex vivo visualization of hypoxic tumour areas by autoradiography. To isolate and quantify gene expression from hypoxic and non-hypoxic tumour tissue respectively, a computer assisted 1:1 template of demarcated [$^{18}$F]-FAZA-positive and [$^{18}$F]-FAZA-negative areas was generated to guide the dissection (FIGS. 1b and c). A Wilcoxon signed rank analysis of the intra-tumour variability of gene expression measured with quantitative real-time RT-PCR showed that all the suggested genes were significantly upregulated in hypoxic tumour areas (H) compared to non-hypoxic tumour areas (N) (FIG. 1d). To mimic the clinical scenario where biopsies may include both well-oxygenated and hypoxic areas, we also compared the gene expression from non-hypoxic tumour areas with whole-tissue section (M) analysis performed in neighbour sections. With this, it is expected to verify, whether the hypoxia-induced upregulation would be traceable in terms of gene expression, irrespective of being quantified from a mix of both hypoxic and non-hypoxic tumour areas. All but three genes were found to be significantly upregulated (FIG. 1e), which supports their potential role as hypoxic markers.

Figure 2:
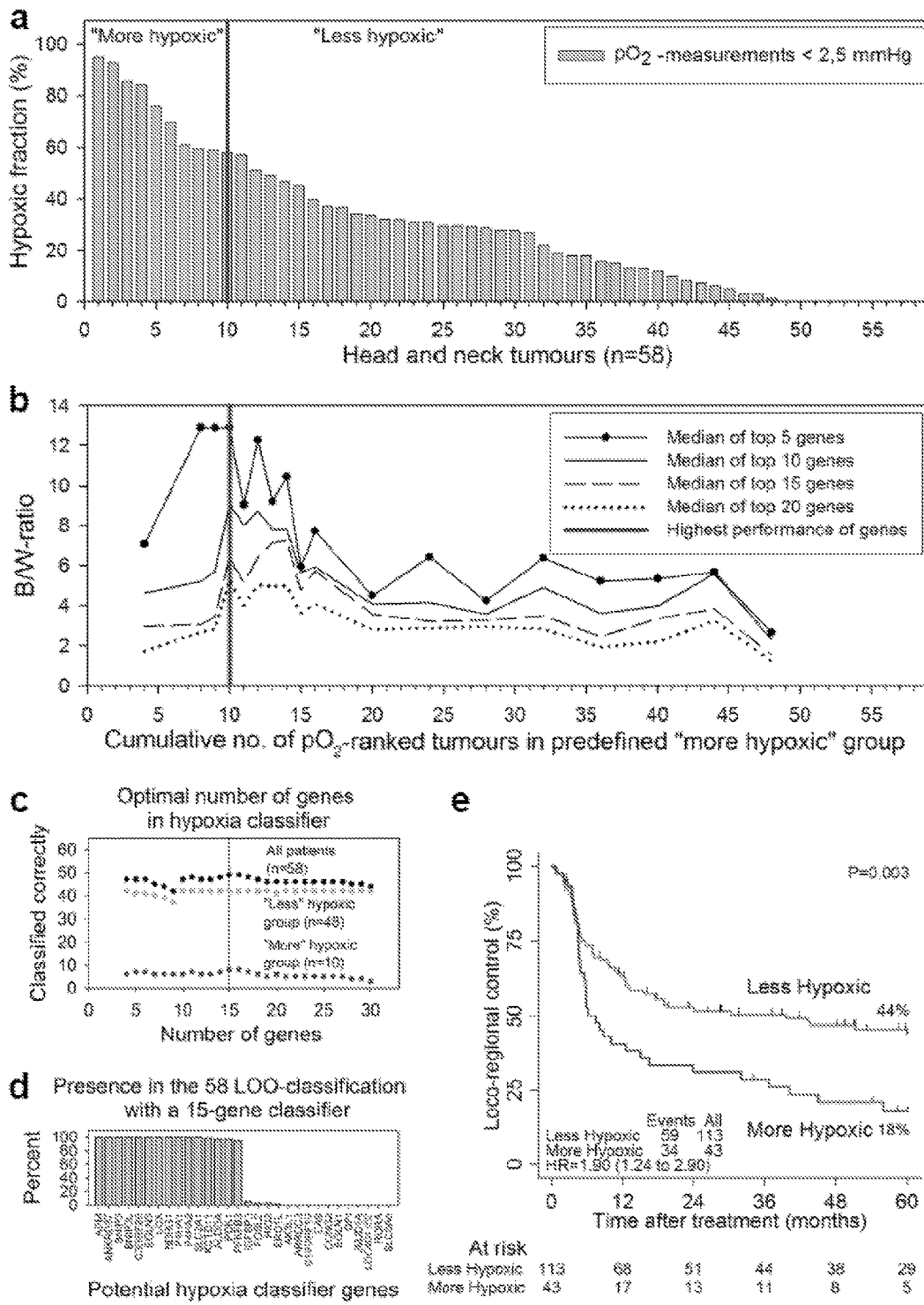
FIG. 2. Development and evaluation of the 15-gene hypoxia gene expression classifier. a. The predefined "more" and "less" hypoxic tumours based on hypoxia evaluation with oxygen electrode in metastatic lymph nodes. b. Basis for the predefined grouping was founded on the most optimal ability to discriminate among the predefined groups, in terms of gene expression (B/W-ratio). c. Number of genes included in the classifier and the ability to classify tumour samples into the same group as they were predefined into, in the "leave one out" cross validation analysis. d. The most frequently present genes in a 15-gene hypoxia classifier. e. Loco-regional tumour control in 156 independent head and neck cancer patients treated with conventional radiotherapy alone and separated into "more" and "less" hypoxic tumours by the 15-gene hypoxia classifier.

The most informative genes for relevant classification in human biopsies were identified by quantifying gene expression in 58 head and neck cancer biopsies that had previously been ranked and evaluated with pO$_2$-electrode measurements of metastatic neck nodes describing their hypoxic status. Thus, a hypoxia gene expression classifier was developed for evaluating tumour hypoxia. To build the hypoxia classifier, the 58 patients were separated and categorized into a "more" hypoxic group containing tumours with the highest frequency of low pO$_2$-electrode measurements and a "less" hypoxic group containing the remaining tumours (FIG. 2a). With this exact split of the hypoxia ranked tumours we obtained two groups with the largest possible distance between mean gene expression levels among the groups and thereby the greatest discrimination in terms of gene expression. In short, the groups were determined by the ratio of between to within variation (B/W) in expression levels. The highest B/W-ratios were obtained when the "more" hypoxic group consisted of the 10 most hypoxic tumours (FIG. 2b). Subsequently, an independent tumour would be classified as belonging to the predefined group ("more" or "less" hypoxic), where the distance from the gene expression level of the independent tumour and to the mean gene expression level of the predefined group, was lowest (See example 2 for information on classification and Tables 2, 3 and 8).

Next, the number of genes was determined to constitute the most optimal classifier. By use of a well established "leave one out" cross validation approach, each sample from the training set was classified—one by one—as belonging to either of the two groups. The classification was based on all samples from the training set, excluding the sample being classified. Each of the 58 samples were then classified with combinations of the 29, 28 etc. best separating genes, respectively. We found the optimal number of genes to classify the most tumours into the same group as they were predefined into to be 15 (FIG. 2c). As the final classifier we chose the 15 candidate genes (Table 2, 3, 7) that were present with the highest frequency in the 58 "leave one out" classifications with a 15-gene classifier (FIG. 2d).

To verify the prognostic relevance of the developed 15-gene hypoxia classifier, the 156 HNSCC biopsies from patients in the placebo group of the DAHANCA 5 trial was categorized as either "more" or "less" hypoxic. These patients had been treated with conventional radiotherapy (62-68 Gy, 2Gy/fx, 5 fx/week) and without hypoxic modification. The prognostic value is illustrated on FIG. 2e, where patients categorized as having "more" hypoxic tumours suffered a significantly poorer actuarial loco-regional tumour control probability at 5 years with a hazard ratio of 1.90 (95% CI 1.24-2.90, p=0.003) as compared to patients categorized as "less" hypoxic.

Figure 3:
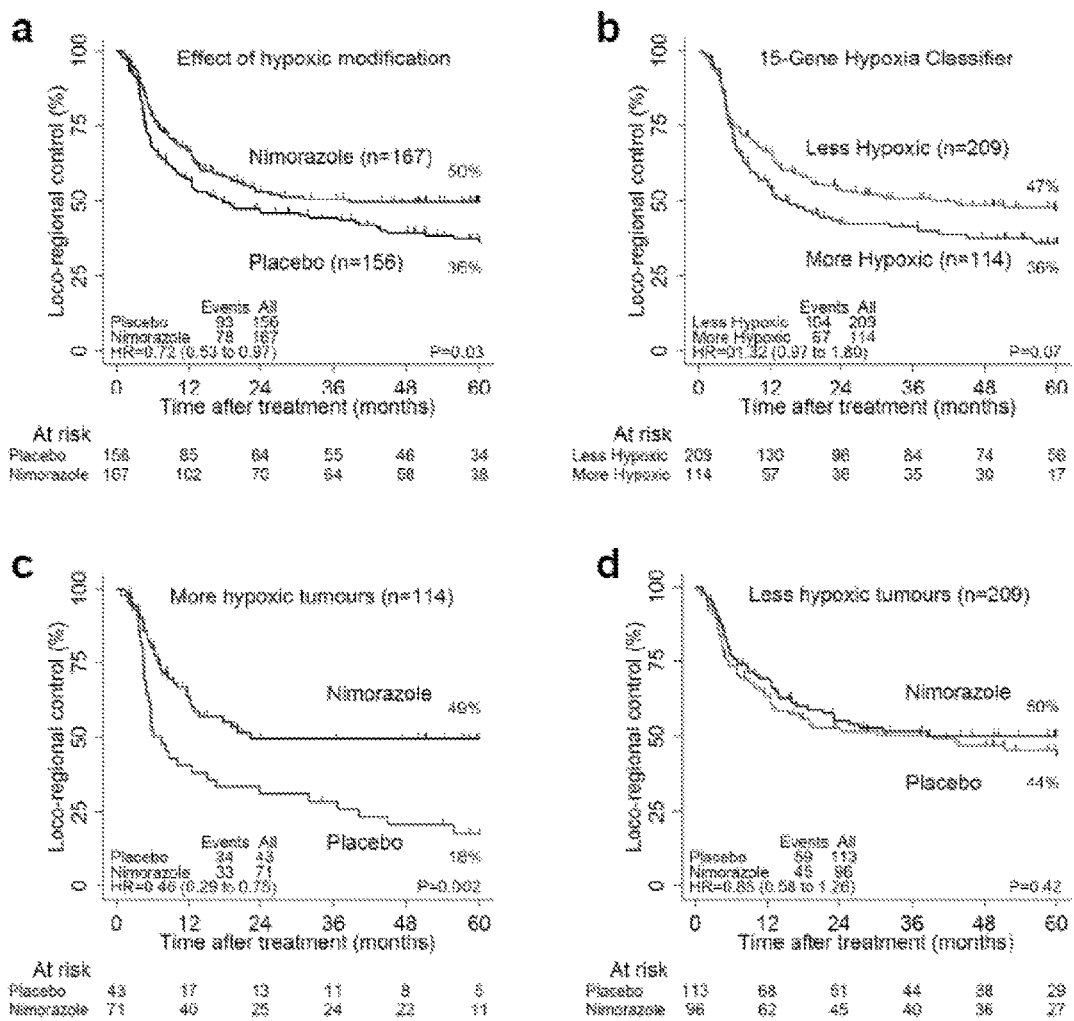
FIG. 3. Prognostic and predictive impact of the 15-gene hypoxia gene expression classifier.
a. Effect of hypoxic modification with Nimorazole in a cohort of 323 head and neck cancer patients randomized for treatment with placebo or Nimorazole in conjunction with conventional radiotherapy. b. Loco-regional tumour control in the groups categorized by the 15-gene hypoxia classifier irrespective of additive treatment with Nimorazole or placebo. c. Loco-regional tumour control in the group categorized as having "more" hypoxic tumours randomized for placebo or Nimorazole. d. Loco-regional tumour control in the group categorized as having "less" hypoxic tumours randomized for placebo or Nimorazole.
Figure 4:
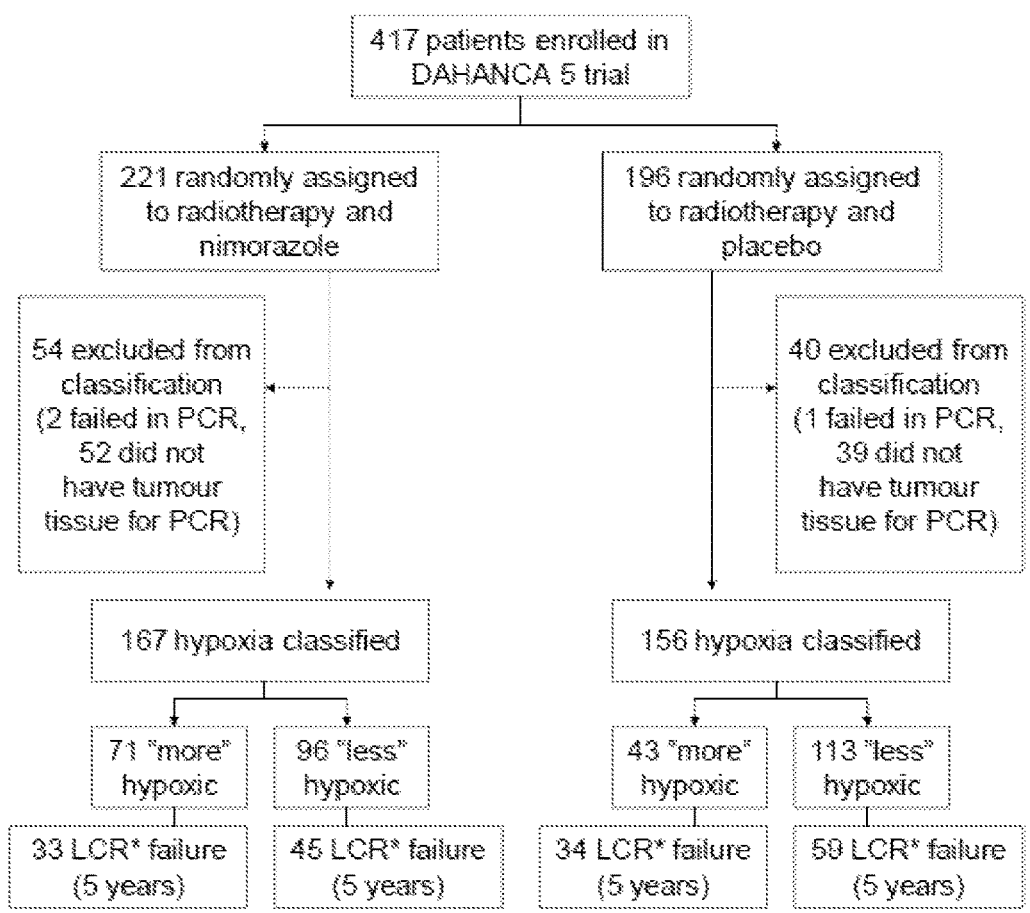
FIG. 4. Overview of DAHANCA 5 study design, *LCR (locoregional)

In order to test the predictive potential for hypoxic modification of radiotherapy obtained by nitroimidazoles, the 15-gene classifier was applied on all 323 HNSCC biopsies from patients enrolled in the DAHANCA 5 trial. These patients had been randomized to either placebo or hypoxic modification with Nimorazole [4-[2-(5-nitro-1H-imidazol-1-yl)ethyl]morpholine] in conjunction with conventional radiotherapy (FIG. 4) and those receiving Nimorazole experienced significantly improved outcome in terms of loco-regional tumour control after radiotherapy (p=0.03) (FIG. 3.a). Overall, the hypoxia classifier categorized 114 tumours (35%) as "more" hypoxic and 209 tumours (65%) as "less" hypoxic. Apart from more node positive disease among the "less" hypoxic tumours, the groups did not differ significantly in terms of patient and tumour characteristics (Table 5). No significant difference in loco-regional tumour control could be detected between the two groups if treatment intervention was ignored (p=0.07), (FIG. 3b). But focusing on the group classified as "more" hypoxic (FIG. 3c), those treated with Nimorazole in conjunction with radiotherapy carried a significantly improved loco-regional tumour control after 5 years when compared to those treated with placebo and radiotherapy (49% vs. 18%, p=0.002). In the group classified as "less" hypoxic (FIG. 3d), a uniform prognosis was observed in terms of loco-regional tumour control (50% vs. 44%, p=0.42) irrespective of whether the patient had been treated with Nimorazole or placebo in conjunction with the radiotherapy. The interaction of gene expression based hypoxic classification and treatment with Nimorazole was found to be significant (p=0 classification, N0 vs. N1-3, HPV/p16-positive tumours vs. HPV/p16-negative tumours, g.007) when adjusting for relevant prognostic parameters (T1-2 vs. T3-4 classification, N0 vs. N1-3, HPV/p16-positive tumours vs. HPV/p16-negative tumours, gender and age). In Cox multivariate regression analysis this was in good correlation with an improved outcome and a hazard ratio of 0.44 (95% CI 0.27-0.73) due to additive treatment with Nimorazole in the group classified as "more" hypoxic, whereas the hazard ratio was 0.97 (95% CI 0.65-1.44) in the group classified as "less" hypoxic (Table 6). These results were not influenced by the HPV/p16-status of the tumours. In the DAHANCA 5 study we have previously shown that hypoxic modification with Nimorazole is without any beneficial effect on loco-regional tumour control of the good prognosis HPV/p16-positive tumors, why a reasonable explanation could be the absence of hypoxia in these tumours. This hypothesis could not be supported by the 15-gene hypoxia classifier that identified similar relative distribution of "more" hypoxic tumours among the HPV/p16-positive tumours as among the HPV/p16-negative tumours (Table 5). Thus, it appears that the cause for different prognosis must be searched elsewhere and might be related to a reduced number of radio-resistant cancer stem cells in the HPV/p16-positive tumors.

It is concluded that the classification as a "more" hypoxic tumour based on the 15-gene hypoxia classifier is associated with a significantly poorer clinical outcome. This outcome can be improved to a level equal to that of the "less" hypoxic tumours by adding the hypoxic radiosensitizer Nimorazole to the radiotherapy. The classifier therefore identifies a subgroup of candidate HNSCC patients for hypoxic modification of radiotherapy. It attains both prognostic and predictive potential and suggests that hypoxic modification of radiotherapy should only be tailored to a subgroup of patients with gene expression classified "more" hypoxic tumours.

Methods Summary

Hypoxia responsive and pH independent genes were identified by microarray analysis (Affymetrix Human Genome U133 Plus 2.0 Array) of relevant cell lines of squamous cell carcinoma, which were cultured in vitro where microenvironment conditions had been manipulated (0.1% vs. 5% $pO_2$ and 7.4 vs. 6.3 pH). In vivo validation was performed by converting the cell lines into a xenograft model and comparing the gene expression in hypoxic and non-hypoxic tumour areas (Wilcoxon signed rank analysis) guided by a well established hypoxic tracer and [$^{18}$F] FAZA. A hypoxia gene expression classifier was build by separating 58 previously hypoxia evaluated formalin fixated paraffin embedded (FFPE) head and neck tumour biopsies into "more" and "less" hypoxic tumours. By quantifying the gene expression in the two formed groups, those genes that displayed the best discriminative capacities were selected and constituted the final 15-gene hypoxia classifier. Independent tumours were then to be classified to the group ("more" or "less" hypoxic), in which their gene expression expressed the greatest similarities. The classifier was tested in an independent set of 323 FFPE biopsies of head and neck cancer, were patients had been randomized and treated with either placebo or the hypoxic modifier Nimorazole in conjunction with conventional radiotherapy[4]. We verified whether the 15-gene hypoxia classifier could identify a subset of tumours having benefit from Nimorazole in conjunction with radiotherapy, by comparing the clinical outcome and the response to hypoxic modification in the two classified groups with log-rank test, cox-regression analysis and test for interaction.

Methods

Biological Material

In vitro experiments were based on human squamous cell carcinoma cell lines UTSCC5, UTSCC14, UTSCC15 (oral carcinoma), FADU$_{DD}$ (hypopharyngeal carcinoma) and SiHa (uterine cervix carcinoma). Xenograft tumours for in vivo validation were generated with cell lines of UTSCC33, FADU$_{DD}$ or SiHa. The hypoxia classifier was generated from 58 previously hypoxia evaluated head and neck cancer biopsies archived as formalin fixated and paraffin embedded samples (FFPE). To test the prognostic and predictive impact of the developed classifier, we used 323 archival supraglottic larynx or pharynx tumour samples (FFPE) from the randomized, double blinded DAHANCA 5 trial.

Identifying Hypoxia Responsive pH Independent Genes

The subjected genes were selected due to data from a previously published in vitro study, where the above mentioned cell lines were exposed to different oxygen concentrations and pH (7.5 or 6.3). Gene expression was analyzed with microarray (Affymetrix—Human Genome U133 Plus 2.0 Array).

Hypoxia Tracer and Isolation of Hypoxic Xenograft Tissue

[$^{18}$F] FAZA was used as exogenous tracer revealing hypoxic tumour areas (<10 mm Hg). Immediately after cryo-section of the excised tumour autoradiography was performed at −20° C. By demarcating [$^{18}$F]-FAZA-positive areas (H) and [$^{18}$F]-FAZA-negative areas (N) a computer-assisted (ImageGauge) 1:1 template was made as suggestion of hypoxic status inside the tumour. Guided by H.E. staining of every 5$^{th}$ section, necrotic areas were avoided if possible and the demarcated areas were dissected. Tissue from multiple corresponding sections—but representing each area—was pooled to achieve sufficient amounts of tissue for qPCR quantification. Every fifth tumour section was left in total (M-area) before RNA extraction, cDNA preparation and qPCR. All sections were preserved in RNA/ater-ICE and at −80° C. prior to dissection.

Gene Expression Quantification

According to manufacturers instructions RNA from fresh frozen tissue was extracted using RNeasy-kit (Quiagen) and cDNA was generated using the High Capacity cDNA Archive kit (Applied Biosystems; ABI). To detect transcripts of interest, TaqMan Gene Expression assay (ABI) was used for all potential classifier and reference genes (Table 7). Reactions were performed on an ABI Prism 7900 Sequence Detector (ABI) and in duplicate. Results were normalized according to the three reference genes RPL37A, ACTR3 and NDFIP1 selected on the basis of the in vitro studies and the geNORM Visual Basic application available in RealTime Statminer (Intergromics). In the xenograft study data were analyzed using the Comparative $C_T$ method. From FFPE tumour biopsies, total RNA was extracted with a silica bead-based, fully automated isolation method for RNA on a robotic Tissue Preparation System using VERSANT Tissue Preparation Reagents (Siemens Healthcare Diagnostics, Tarrytown, N.Y.). The system extracts total nucleic acids from only one 5 or 10 μm whole FFPE tissue section without applying classical xylene deparaffinization step. Final eluate of 100 μl is digested by an automated DNaseI treatment step for accurate expression profiling. A pre-amplification step of 10 cycles was performed according to manufacturers details (TaqMan PreAmp, ABI) before RT-qPCR. Results were normalized according to the three reference genes mentioned above. $C_t$ values above 35 or with a standard deviation above 0.3 were dismissed and interpreted as empty wells. We used RealTime Statminer (Intergromics) to calculate ΔCt-values. Gene expression level was quantified as $2^{-\Delta Ct}$ and log 2-transformed before building the classifier.

Statistical Analyses

H, N and M areas of the xenograft tumours were compared with the Wilcoxon's signed rank analysis. End point used in the evaluation of the classifier in the independent data set, was actuarial loco-regional tumour control probability at 5 years, defined as complete and persistent disappearance of the disease in the primary tumour (T site) and regional lymph nodes (N site) after radiotherapy. Failure was recorded in the event of recurrent tumour or if the tumour never completely disappeared. Follow-up was completed as part of the original study. All patients were observed for at least 5 years or until death. Patient and tumour characteristics of the "more" and "less" hypoxic" groups divided by the hypoxia classifier were compared using the Chi Squared test for categorical variables. Loco-regional tumour control in the two groups was illustrated with a Kaplan Meier plot and compared using the log-rank test. A Cox multivariate proportionate-hazards analysis was used to assess the independence and prognostic significance of tumour characteristics. Included parameters in the analysis were tumour and nodal classification, tumour site, gender, age above or below median, Nimorazole vs. placebo, HPV/p16-status and hypoxic status as categorized by the 15-gene hypoxia classifier. Statistical analyses were performed with STATA 10 software. All p-values are two-sided with a level of significance at 5%. Hazard ratios (HR) are presented with 95% Cl.

TABLE 4

Hypoxia responsive genes

| In vitro derived genes | Included in Hypoxia classifer | Function |
| --- | --- | --- |
| ADM | ADM | Stress response |
| AK3L1 | | Nucleotide metabolism |
| ALDOA | ALDOA | Glucose metabolism |
| ANKRD37 | ANKRD37 | Protein-protein interactions |
| ARRDC3 | | Cell surface metabolism |
| BNIP3 | BNIP3 | Apoptosis |
| BNIP3L | BNIP3L | Apoptosis |
| C3orf28 | C3orf28 | Unknown |
| C18orf19 | | Unknown |
| CCNG2 | | Cell cycle regulation |
| EGLN1 | | Regulation of HIF-1 activity |
| EGLN3 | EGLN3 | Regulation of HIF-1 activity |
| ERO1L | | Oxidoreductase |
| FOSL2 | | Cell proliferation |
| GPI | | Glucose metabolism |
| HIG2 | | Stress response |
| IGFBP3 | | Cell proliferation |
| JMJD1A | | Histone demethylase |
| KCTD11 | KCTD11 | Apoptosis |
| LOC401152 | | Unknown |
| LOX | LOX | Extracellular-matrix metabolism |
| NDRG1 | NDRG1 | Stress response |
| P4HA1 | P4HA1 | Extracellular-matrix metabolism |
| P4HA2 | P4HA2 | Extracellular-matrix metabolism |
| PDK1 | PDK1 | Energy metabolism |
| PFKFB3 | PFKFB3 | Glucose metabolism |
| RORA | | Unknown |
| SLC2A1 | SLC2A1 | Glucose metabolism |
| SLC6A8 | | Glucose metabolism |
| Gene based on previous studies | | |
| CA9 | | pH-regulation |

TABLE 5

Patient and tumour characteristics

|  | All patients (n = 323) | | Placebo (n = 43) | | Nimorazole (n = 71) | | Placebo (n = 113) | | Nimorazole (n = 96) | | |
|---|---|---|---|---|---|---|---|---|---|---|---|
| | | | "More" hypoxic (n = 114) | | | | "Less" hypoxic (n = 209) | | | | |
| Patient/Tumor Data | n | (%) | n | (%) | n | (%) | n | (%) | n | (%) | P* |
| Age (years) | | | | | | | | | | | |
| Median | 60 | | 62 | | 62 | | 67 | | 60 | | |
| Range | (24-84) | | (36-79) | | (34-83) | | (24-84) | | (28-83) | | |
| <60 years | 159 | 49 | 19 | 44 | 33 | 46 | 59 | 52 | 48 | 60 | n.s. |
| >60 years | 164 | 61 | 24 | 56 | 38 | 54 | 54 | 48 | 48 | 60 | |
| Gender | | | | | | | | | | | |
| Female | 92 | 28 | 11 | 26 | 18 | 25 | 30 | 27 | 33 | 34 | n.s. |
| Male | 231 | 72 | 32 | 74 | 53 | 75 | 83 | 73 | 63 | 66 | |
| Tumor Site | | | | | | | | | | | |
| Supraglottic larynx | 100 | 31 | 13 | 30 | 24 | 34 | 32 | 28 | 31 | 32 | n.s. |
| Hypopharynx | 44 | 14 | 7 | 16 | 11 | 15 | 13 | 12 | 13 | 14 | |
| Oropharynx | 141 | 44 | 20 | 47 | 30 | 42 | 54 | 48 | 37 | 39 | |
| Rhinopharynx | 38 | 12 | 3 | 7 | 6 | 8 | 14 | 12 | 15 | 16 | |
| Tumor Stage | | | | | | | | | | | |
| T1-2 | 155 | 48 | 19 | 44 | 29 | 41 | 53 | 47 | 54 | 56 | n.s. |
| T3-4 | 166 | 62 | 24 | 56 | 42 | 59 | 60 | 53 | 42 | 44 | |
| Nodal stage | | | | | | | | | | | |
| N0 | 138 | 43 | 23 | 53 | 34 | 48 | 39 | 35 | 42 | 44 | 0.05 |
| N1-3 | 185 | 57 | 20 | 47 | 37 | 62 | 74 | 65 | 64 | 56 | |
| Disease stage | | | | | | | | | | | |
| I-II | 66 | 20 | 11 | 26 | 16 | 23 | 18 | 16 | 21 | 22 | n.s. |
| III-IV | 267 | 80 | 32 | 74 | 55 | 77 | 95 | 84 | 75 | 78 | |
| Tumor differentiation | | | | | | | | | | | |
| Well or moderate | 124 | 38 | 18 | 42 | 32 | 45 | 45 | 40 | 29 | 30 | n.s. |
| Poor | 199 | 62 | 25 | 58 | 39 | 66 | 68 | 60 | 67 | 70 | |
| HPV/P16-status | | | | | | | | | | | |
| Negative | 234 | 72 | 33 | 77 | 48 | 68 | 86 | 76 | 67 | 70 | n.s. |
| Positive | 83 | 26 | 9 | 21 | 22 | 31 | 25 | 22 | 27 | 28 | |
| Unknown | 6 | 2 | 1 | 2 | 1 | 1 | 2 | 2 | 2 | 2 | | n.s., not significant
*Chi-squared test comparasion between "more" and "less" hypoxic groups

TABLE 6

| | Univariate analysis | | | Multivariate analysis | | |
|---|---|---|---|---|---|---|
| | All patients HR (95% CI) | "More" hypoxic HR (95% CI) | "Less" hypoxic HR (95% CI) | All patients HR (95% CI) | "More" hypoxic HR (95% CI) | "Less" hypoxic HR (95% CI) |
| Tumour classification: (T3-4 vs T1-2) | 1.40 (1.10-2.02) | 1.11 (0.68-1.81) | 1.69 (1.14-2.49) | 1.45 (1.05-1.98) | 1.12 (0.65-1.91) | 1.66 (1.11-2.47) |
| Nodal classification (N+ vs N0) | 1.97 (1.43-2.71) | 1.56 (0.97-2.55) | 2.54 (1.63-3.97) | 2.20 (1.56-3.09) | 1.71 (1.01-2.66) | 3.19 (1.95-5.24) |
| Tumour Site (pharynx vs larynx) | 1.21 (0.87-1.67) | 1.44 (0.85-2.44) | 1.10 (0.73-1.67) | 1.16 (0.61-1.66) | 1.50 (0.84-2.67) | 0.89 (0.56-1.42) |
| Gender (male vs female) | 1.44 (1.02-2.04) | 1.42 (0.79-2.57) | 1.40 (0.91-2.16) | 1.25 (0.87-1.78) | 1.48 (0.76-2.85) | 1.12 (0.72-1.77) |
| Age (≥60 vs <60) | 1.15 (0.85-1.56) | 1.00 (0.68-1.77) | 1.18 (0.80-1.73) | 1.07 (0.79-1.45) | 1.19 (0.68-1.84) | 1.05 (0.71-1.55) |
| Nimorazole vs placebo | 0.72 (0.53-0.97) | 0.46 (0.29-0.75) | 0.85 (0.50-1.38) | 0.70 (0.51-0.96) | 0.44 (0.27-0.73) | 0.97 (0.65-1.44) |
| HPV/p16-positive vs HPV/p 6-negative | 0.74 (0.66-0.97) | 0.73 (0.47-1.14) | 0.72 (0.50-1.04) | 0.41 (0.27-0.61) | 0.36 (0.19-0.69) | 0.41 (0.24-0.70) |
| "More" hypoxic vs "Less" hypoxic | 1.32 (0.97-1.80) | | | 1.55 (1.21-2.15) | | |

*Parameters included in the Cox proportionate multivariate analysis: Tumor and nodal classifcation, site, gender, age (median), Nimorazole vs placebo, HPV/p16-status, and hypoxic status as categorized by the 15-gene hypoxic classifier.

TABLE 7

Hypoxia classifer genes

NDRG1 (Hs00688389), PFKFB3 (Hs00998700),

SLC2A1 (Hs185278117), BNP3L (Hs00188949), IGFBP3

(Hs00181211), LOX (Hs001847700), C3orf28

(Hs01055823), BNIP3 (Hs00969293), ADM (Hs02562698),

EGLN3 (Hs00222966), P4HA2 (Hs00989996), CA9

(Hs00154208), RORA (Hs00536545), P4HA1
(Hs00914594),

ANKRD37 (Hs00699181), HIG2 (Hs00203383), GPI (Hs00976711), KCTD11 (Hs00922550), SLC6A8

(Hs00373917), FOSL2 (Hs00232013), LOC401152

(Hs00386171), ERO1L (Hs00386171), JMJD1A (Hs00218331), PDK1 (Hs00326943), EGLN1
(Hs00254392),

CCNG2 (Hs00171119), ALDOA (Hs00605108),

AK3L1 (Hs00652236), C18orf19(Hs00935911),

ARRDC3 (Hs00385843)

Reference genes

ACTR3 (Hs01029161), NDFP1 (Hs00228968),

RPL37A (forward primer TGT GGT TCC TGC ATG AAG ACA, reverse primer GTG ACA GCG GAA GTG GTA TTG TAC, probe TGG CTG GCG GTG CCT GGA)

Example 2

Separating the 58 HNSCC (Training Set) into a "More" and a "Less" Hypoxic Group

The 58 HNSCC samples were previously ranked according to the relative number of pO2-electrode measurements obtained in metastatic lymph nodes. Based on the performance of previously validated hypoxia responsive genes, we chose to split patients into a "more" and a "less" hypoxic group. We used the ratio (B/W) of between group variation (B) to within group variation (W) to select genes useful for discrimination of samples. The ability of each gene to separate the two groups from each other can be described with the B/W-ratio. The higher the ratio, the more distance in the expression of the gene in question between the two groups. Therefore the power to classify independent samples into one of the groups favours a high B/W-ratio compared to a low B/W-ratio. By choosing a split of the pO2-ranked patients were we observed the highest B/W-ratio among the genes we supported the power of the developed classifier.

B/W-Ratio:

$$B = \frac{1}{K-1} \sum_i n_i (\overline{z_i} \cdot \overline{z})^2,$$

where K is the number of groups; i is the ith group and z is the mean of all samples (n in total). B is a weighted sum of how far the mean of group i is to the global mean.

$$W = \frac{1}{n-K} \sum_i (n_i - 1) s_i^2,$$

where $s_i^2$ is an estimate of the variance of group i. W is a weighted sum of the estimated variances constituting an estimate of the common variance.

Classification of Independent Samples

To classify a new an independent sample we measure the distance from the new sample to the existing samples (the training set samples and the pre-defined groups). For each of the M genes in the classifier we calculate the distance (D) between the new sample's expression value and the means of the samples in the two pre-defined groups, respectively.

$$D_i = \sum_m \frac{(y_m - z_{im})^2}{W_m},$$

where m refers to the mth gene out of the M genes, i is the group, z is the mean of the group, W is the calculated common variance and y is the gene expression of the classified sample.

The group i where the smallest D is calculated is most similar to the sample being classified, why the sample is being classified as belonging to this group.

Example 3

TABLE 8

Mean (−ΔCt)-value ($z_{im}$) and variance ($W_m$), correlated to ACTR3, NDFIP1 and RPL37A. Mean values are expressed as the log2-transformed fold difference in expression levels between each test genes and the reference genes. Fold difference is calculated as $2^{-\Delta Ct}$. ΔCt is calculated as the Ct value of the test gene minus the Ct value of the reference genes. The Ct value of the reference genes is the geometric mean of the Ct values of each of the three reference genes. The Ct value (cycle threshold) is defined as the number of cycles required for the fluorescent signal to cross a certain threshold. The threshold is an arbitrary level of fluorescence chosen on the basis of the baseline variability.

| Gene | Mean/Variance of 'more hypoxic' group | Mean/Variance of 'less hypoxic' group | Estimated common variance |
|---|---|---|---|
| ADM | −0.75/0.77 | −2.35/1.54 | 1.40 |
| ANKRD37 | −4.16/1.35 | −5.65/0.60 | 0.70 |
| P4HA2 | −2.71/0.11 | −4.21/1.01 | 0.90 |
| NDRG1 | 2.36/1.48 | 0.83/2.07 | 1.90 |
| SLC2A1 | 1.96/1.31 | 0.53/1.85 | 1.77 |
| P4HA1 | −4.88/2.04 | −6.35/1.16 | 1.37 |
| LOX | −1.09/1.68 | −2.43/1.96 | 1.92 |
| C3orf28 | −0.64/0.71 | −1.29/0.47 | 0.51 |
| BNIP3L | −0.46/0.28 | −1.09/0.53 | 0.49 |
| BNIP3 | −0.63/0.44 | −1.52/1.40 | 1.24 |
| EGLN3 | −0.55/2.08 | −1.56/1.46 | 1.56 |
| PDK1 | −1.71/0.58 | −2.31/0.47 | 0.48 |
| PFKFB3 | 0.46/0.95 | −0.24/1.18 | 1.14 |
| KCTD11 | −2.08/2.34 | −3.13/1.78 | 1.85 |
| ALDOA | −0.67/1.17 | −1.55/1.52 | 1.46 |

Example 4

The expression levels of the genes of the present invention were determined in formalin samples of cells from more hypoxic and less hypoxic cancers, respectively, thus representing a predetermined more hypoxic group and a predetermined less hypoxic group according to the invention. The geometric mean ΔCt-value of the tested samples, and the variance and estimated common variance were calculated.

TABLE 9

Mean ΔCt-value and common variance for genes correlated to ACTR3, NDFIP1 and RPL37A.

| Gene | Mean/Variance of 'more hypoxic' group | Mean/Variance of 'less hypoxic' group | Estimated common variance |
|---|---|---|---|
| ADM | −0.75/0.77 | −2.35/1.54 | 1.40 |
| ANKRD37 | −4.16/1.35 | −5.65/0.60 | 0.70 |
| P4HA2 | −2.71/0.11 | −4.21/1.01 | 0.90 |
| NDRG1 | 2.36/1.48 | 0.83/2.07 | 1.90 |
| SLC2A1 | 1.96/1.31 | 0.53/1.85 | 1.77 |
| P4HA1 | −4.88/2.04 | −6.35/1.16 | 1.37 |
| LOX | −1.09/1.68 | −2.43/1.96 | 1.92 |
| C3orf28 | −0.64/0.71 | −1.29/0.47 | 0.51 |
| BNIP3L | −0.46/0.28 | −1.09/0.53 | 0.49 |
| BNIP3 | −0.63/0.44 | −1.52/1.40 | 1.24 |
| EGLN3 | −0.55/2.08 | −1.56/1.46 | 1.56 |
| PDK1 | −1.71/0.58 | −2.31/0.47 | 0.48 |
| PFKFB3 | 0.46/0.95 | −0.24/1.18 | 1.14 |
| KCTD11 | −2.08/2.34 | −3.13/1.78 | 1.85 |
| ALDOA | −0.67/1.17 | −1.55/1.52 | 1.46 |

The D-value is calculated according to the general formular:

$$D_i = \sum_m \frac{(y_m - z_{im})^2}{W_m},$$

where m refers to the mth gene out of the 1-15 genes, i is the group (more or less hypoxic), z is the mean of the group (such as indicated in for example table 2 and 3), W is the calculated common variance and y is the gene expression of the classified sample correlated to the mean expression of ACTR3, NDFIP1 and RPL37A. For determining the hypoxia profile of a cancer, the D-value for both groups must be calculated, using one or more of the 15 genes of table 9. For example, using the values of table 9 for the first four genes, ADM, ANKRD37, P4H4 and NDRG1, $D_{more}$ and $D_{less}$ is be calculated as:

$$D_{more} = \frac{(y_{ADM} - (-0.75))^2}{1.40} + \frac{(y_{ANKRD37} - (-4.16))^2}{0.70} + \frac{(y_{P4HA2} - (-2.71))^2}{0.90} + \frac{(y_{NDRG1} - (2.36))^2}{1.90}$$

$$D_{less} = \frac{(y_{ADM} - (-2.35))^2}{1.40} + \frac{(y_{ANKRD37} - (-5.65))^2}{0.70} + \frac{(y_{P4HA2} - (-4.21))^2}{0.90} + \frac{(y_{NDRG1} - (0.83))^2}{1.90}$$

Similarly, the values of all 15 genes could be used, as well as any intermediate number of the 1-15 genes. Based on the calculated values, the oxygen status of a cancer is classified as low oxygen/(more) hypoxic, if $D_{more}$ calculated on the basis of the ΔCt and variance values in table 9 for the "more hypoxic group" are lower than the corresponding $D_{less}$ calculated on the basis of the same genes corresponding ΔCt and variance values for the "less hypoxis group". Conversely, the oxygen status of a cancer is classified as high oxygen/(less) hypoxic, if $D_{less}$ calculated on the basis of the ΔCt and variance values provided in table 9 for the "less hypoxic group" is lower than the corresponding $D_{more}$ calculated on the basis of the same genes corresponding ΔCt and variance values for the "more hypoxis group".

```
Sequences
                                                              SEQ ID NO: 1
Gene ADM
ADM, Gene ID: 133, NCBI Reference Sequence: NC_000011.9

SEQ ID NO: 2
Gene ALDOA
ALDOA, Gene ID: 226, NCBI Reference Sequence: NC_000016.9

SEQ ID NO: 3
Gene ANKRD37
ANKRD37, Gene ID: 353322, NCBI Reference Sequence: NC_000004.11

SEQ ID NO: 4
Gene BNIP3
BNIP3, Gene ID: 664, NCBI Reference Sequence: NC_000010.10

SEQ ID NO: 5
Gene BNIP3L
BNIP3L - NCBI Reference Sequence: NC_000008.10

SEQ ID NO: 6
Gene C3orf28
C3orf28, Gene ID: 26355, NCBI Reference Sequence: NC_000003.11

SEQ ID NO: 7
Gene EGLN3
EGLN3, Gene ID: 112399, NCBI Reference Sequence: NC_000014.8

SEQ ID NO: 8
Gene KCTD11
KCTD11, Gene ID: 147040, NCBI Reference Sequence: NC_000017.10

SEQ ID NO: 9
Gene LOX
LOX, Gene ID: 4015, NCBI Reference Sequence: NC_000005.9
```

```
                                                                         SEQ ID NO: 10
Gene NDRG1
NDRG1 , NCBI accession no: NG_007943

SEQ ID NO: 11
Gene P4HA1
P4HA1, Gene ID: 5033, NCBI Reference Sequence: NC_000010.10

SEQ ID NO: 12
Gene P4HA2
P4HA2, Gene ID: 8974, NCBI Reference Sequence: NC_000005.9

SEQ ID NO: 13
Gene PDK1
PDK1, Gene ID: 5163, NCBI Reference Sequence: NC_000002.11

SEQ ID NO: 14
Gene PFKFB3
PFKFB3, NCBI Reference Sequence: NC_000010.10

SEQ ID NO: 15
Gene SLC2A1
SLC2A1, Gene ID: 6513, NCBI Reference Sequence: NC_000001.10

SEQ ID NO: 16
transcript
ADM NM_001124.1
Locus NM_001124 1449 by mRNA linear PRI 18-JUL-2010
DEFINITION Homo sapiens adrenomedullin (ADM), mRNA.
ACCESSION NM_001124
VERSION NM_001124.1 GI:4501944

SEQ ID NO.: 17
transcript
ALDOA NM 184041.1
NM_184041 1572 by mRNA linear PRI 16-MAY-2010
DEFINITION Homo sapiens aldolase A, fructose-bisphosphate (ALDOA), transcript
variant 2, mRNA.
ACCESSION NM_184041
VERSION NM_184041.1 GI:34577109
SOURCE Homo sapiens (human)

SEQ ID NO.: 18
transcript
ALDOA NM 184043.1
Homo sapiens aldolase A, fructose-bisphosphate (ALDOA), transcript variant 3, mRNA
LOCUS NM_184043 1594 by mRNA linear PRI 16-MAY-2010
DEFINITION Homo sapiens aldolase A, fructose-bisphosphate (ALDOA), transcript
variant 3, mRNA.
ACCESSION NM_184043
VERSION NM_184043.1 GI:34577111
SOURCE Homo sapiens (human)

SEQ ID NO.: 19
transcript
ALDOA NM_001127617.1
Homo sapiens aldolase A, fructose-bisphosphate (ALDOA), transcript variant 4, mRNA
LOCUS NM_001127617 1478 by mRNA linear PRI 16-MAY-2010
DEFINITION Homo sapiens aldolase A, fructose-bisphosphate (ALDOA), transcript
variant 4, mRNA.
ACCESSION NM_001127617
VERSION NM_001127617.1 GI:193794813
SOURCE Homo sapiens (human)

SEQ ID NO.: 20
transcript
ALDOA NM_000034.2
Homo sapiens aldolase A, fructose-bisphosphate (ALDOA), transcript variant 1, mRNA
LOCUS NM_000034 2353 by mRNA linear PRI 16-MAY-2010
DEFINITION Homo sapiens aldolase A, fructose-bisphosphate (ALDOA), transcript
variant 1, mRNA.
ACCESSION NM_000034
VERSION NM_000034.2 GI:34577108
SOURCE Homo sapiens (human)
```

-continued

SEQ ID NO.: 21 transcript
ANKRD37 NM_181726.2
Homo sapiens ankyrin repeat domain 37 (ANKRD37), mRNA
LOCUS       NM_181726                934 bp    mRNA    linear   PRI 07-MAY-2010
DEFINITION  Homo sapiens ankyrin repeat domain 37 (ANKRD37), mRNA.
ACCESSION   NM_181726
VERSION     NM_181726.2  GI:142371740
SOURCE      Homo sapiens (human)

SEQ ID NO.: 22 transcript
BNIP3 NM_004052.2
Homo sapiens BCL2/adenovirus E1B 19kDa interacting protein 3 (BNIP3), nuclear
gene encoding mitochondrial protein, mRNA
LOCUS       NM_004052               1535 bp    mRNA    linear   PRI 27-JUN-2010
DEFINITION  Homo sapiens BCL2/adenovirus E1B 19kDa interacting protein 3
            (BNIP3), nuclear gene encoding mitochondrial protein, mRNA.
ACCESSION   NM_004052
VERSION     NM_004052.2  GI:7669480
SOURCE      Homo sapiens (human)

SEQ ID NO.: 23 transcript
BNIP3L NM_004331.2
Homo sapiens BCL2/adenovirus E1B 19kDa interacting protein 3-like (BNIP3L), mRNA
LOCUS       NM_004331               3505 bp    mRNA    linear   PRI 25-APR-2010
DEFINITION  Homo sapiens BCL2/adenovirus E1B 19kDa interacting protein 3-like
            (BNIP3L), mRNA.
ACCESSION   NM_004331
VERSION     NM_004331.2  GI:47078259
SOURCE      Homo sapiens (human)

SEQ ID NO.: 24 transcript
C3orf28 NM_014367.3
Homo sapiens family with sequence similarity 162, member A (FAM162A), mRNA
LOCUS       NM_014367                838 bp    mRNA    linear   PRI 14-FEB-2010
DEFINITION  Homo sapiens family with sequence similarity 162, member A
            (FAM162A), mRNA.
ACCESSION   NM_014367
VERSION     NM_014367.3  GI:49355720
SOURCE      Homo sapiens (human)

SEQ ID NO.: 25 transcript
EGLN3 NM_022073.3
Homo sapiens egl nine homolog 3 (C. elegans) (EGLN3), mRNA
LOCUS       NM_022073               2722 bp    mRNA    linear   PRI 04-JUL-2010
DEFINITION  Homo sapiens egl nine homolog 3 (*C. elegans*) (EGLN3), mRNA.
ACCESSION   NM_022073 NM_033344
VERSION     NM_022073.3  GI:130509310
SOURCE      Homo sapiens (human)

SEQ ID NO.: 26 transcript
KCTD11 NM_001002914.2
Homo sapiens potassium channel tetramerisation domain containing 11 (KCTD11),
mRNA
LOCUS       NM_001002914            3081 bp    mRNA    linear   PRI 04-MAR-2010
DEFINITION  Homo sapiens potassium channel tetramerisation domain containing 11
            (KCTD11), mRNA.
ACCESSION   NM_001002914 XM_085689
VERSION     NM_001002914.2  GI:146149101
SOURCE      Homo sapiens (human)

SEQ ID NO.: 27 transcript
LOX NM_002317.4
Homo sapiens lysyl oxidase (LOX), mRNA
LOCUS       NM_002317               3925 bp    mRNA    linear   PRI 05-APR-2010
DEFINITION  Homo sapiens lysyl oxidase (LOX), mRNA.
ACCESSION   NM_002317
VERSION     NM_002317.4  GI:196114808
KEYWORDS
SOURCE      Homo sapiens (human)

SEQ ID NO.: 28
transcript
LOCUS NM_002317 5177 bp mRNA linear PRI 18-JUL-2010
DEFINITION Homo sapiens lysyl oxidase (LOX), transcript variant 1, mRNA.
ACCESSION NM_002317
VERSION NM_002317.5 GI:296010938
SOURCE Homo sapiens (human)

SEQ ID NO.: 29
transcript
NDRG1 NM_001135242.1
Homo sapiens N-myc downstream regulated 1 (NDRG1), transcript variant 1, mRNA
LOCUS NM_001135242 3520 bp mRNA linear PRI 25-JUL-2010
DEFINITION Homo sapiens N-myc downstream regulated 1 (NDRG1), transcript
variant 1, mRNA.
ACCESSION NM_001135242
VERSION NM_001135242.1 61:207028747
SOURCE Homo sapiens (human)

SEQ ID NO.: 30
transcript
NDRG1 NM_006096.3
Homo sapiens N-myc downstream regulated 1 (NDRG1), transcript variant 2, mRNA
LOCUS NM_006096 3123 bp mRNA linear PRI 18-JUL-2010
DEFINITION Homo sapiens N-myc downstream regulated 1 (NDRG1), transcript
variant 2, mRNA.
ACCESSION NM_006096
VERSION NM_006096.3 GI:207028746
SOURCE Homo sapiens (human)

SEQ ID NO.: 31
transcript
P4HA1 NM_001017962.2
Homo sapiens prolyl 4-hydroxylase, alpha polypeptide I (P4HA1), transcript variant 2,
mRNA
LOCUS NM_001017962 2860 bp mRNA linear PRI 01-AUG-2010
DEFINITION Homo sapiens prolyl 4-hydroxylase, alpha polypeptide I (P4HA1),
transcript variant 2, mRNA.
ACCESSION NM_001017962
VERSION NM_001017962.2 GI:217272847
SOURCE Homo sapiens (human)

SEQ ID NO.: 32
transcript
P4HA1 NM_001142595.1
Homo sapiens prolyl 4-hydroxylase, alpha polypeptide I (P4HA1), transcript variant 3,
mRNA
LOCUS NM_001142595 2953 bp mRNA linear PRI 05-JUL-2010
DEFINITION Homo sapiens prolyl 4-hydroxylase, alpha polypeptide I (P4HA1),
transcript variant 3, mRNA.
ACCESSION NM_001142595
VERSION NM_001142595.1 GI:217272848
SOURCE Homo sapiens (human)

SEQ ID NO.: 33
transcript
P4HA1 NM_001142596.1
Homo sapiens prolyl 4-hydroxylase, alpha polypeptide I (P4HA1), transcript variant 4,
mRNA
LOCUS NM_001142596 2806 bp mRNA linear PRI 05-JUL-2010
DEFINITION Homo sapiens prolyl 4-hydroxylase, alpha polypeptide I (P4HA1),
transcript variant 4, mRNA.
ACCESSION NM_001142596
VERSION NM_001142596.1 GI:217272850
SOURCE Homo sapiens (human)

SEQ ID NO.: 34
transcript
P4HA1 NM_000917.3
Homo sapiens prolyl 4-hydroxylase, alpha polypeptide I (P4HA1), transcript variant 1,
mRNA
LOCUS NM_000917 2860 bp mRNA linear PRI 18-JUL-2010
DEFINITION Homo sapiens prolyl 4-hydroxylase, alpha polypeptide I (P4HA1),
transcript variant 1, mRNA.
ACCESSION NM_000917
VERSION NM_000917.3 GI:217272856
SOURCE Homo sapiens (human)

SEQ ID NO.: 35 transcript
P4HA2 NM_001017973.1
Homo sapiens prolyl 4-hydroxylase, alpha polypeptide II (P4HA2), transcript variant 2, mRNA
LOCUS NM_001017973 2582 bp mRNA linear PRI 12-MAR-2010
DEFINITION Homo sapiens prolyl 4-hydroxylase, alpha polypeptide II (P4HA2), transcript variant 2, mRNA.
ACCESSION NM_001017973
VERSION NM_001017973.1 GI:63252890
SOURCE Homo sapiens (human)

SEQ ID NO.: 36 transcript
P4HA2 NM_001017974.1
Homo sapiens prolyl 4-hydroxylase, alpha polypeptide II (P4HA2), transcript variant 3, mRNA
LOCUS NM_001017974 2110 bp mRNA linear PRI 12-MAR-2010
DEFINITION Homo sapiens prolyl 4-hydroxylase, alpha polypeptide II (P4HA2), transcript variant 3, mRNA.
ACCESSION NM_001017974
VERSION NM_001017974.1 GI:63252892
SOURCE Homo sapiens (human)

SEQ ID NO.: 37 transcript
P4HA2 NM_001142598,1
Homo sapiens prolyl 4-hydroxylase, alpha polypeptide II (P4HA2), transcript variant 4, mRNA
LOCUS NM_001142598 2246 bp mRNA linear PRI 12-MAR-2010
DEFINITION Homo sapiens prolyl 4-hydroxylase, alpha polypeptide II (P4HA2), transcript variant 4, mRNA.
ACCESSION NM_001142598
VERSION NM_001142598.1 GI:217272860
SOURCE Homo sapiens (human)

SEQ ID NO.: 38 transcript
P4HA2 NM_001142599.1
Homo sapiens prolyl 4-hydroxylase, alpha polypeptide II (P4HA2), transcript variant 5, mRNA
LOCUS NM_001142599 2252 bp mRNA linear PRI 12-MAR-2010
DEFINITION Homo sapiens prolyl 4-hydroxylase, alpha polypeptide II (P4HA2), transcript variant 5, mRNA.
ACCESSION NM_001142599
VERSION NM_001142599.1 GI:217272862
SOURCE Homo sapiens (human)

SEQ ID NO.: 39 transcript
P4HA2 NM_004199,2
Homo sapiens prolyl 4-hydroxylase, alpha polypeptide II (P4HA2), transcript variant 1, mRNA
LOCUS NM_004199 2588 bp mRNA linear PRI 12-MAR-2010
DEFINITION Homo sapiens prolyl 4-hydroxylase, alpha polypeptide II (P4HA2), transcript variant 1, mRNA.
ACCESSION NM_004199
VERSION NM_004199.2 GI:63252889
SOURCE Homo sapiens (human)

SEQ ID NO.: 40 transcript
PDK1 NM_002610.3
Homo sapiens pyruvate dehydrogenase kinase, isozyme 1 (PDK1), nuclear gene encoding mitochondrial protein, mRNA
LOCUS NM_002610 4576 bp mRNA linear PRI 25-JUL-2010
DEFINITION Homo sapiens pyruvate dehydrogenase kinase, isozyme 1 (PDK1), nuclear gene encoding mitochondrial protein, mRNA.
ACCESSION NM_002610
VERSION NM_002610.3 GI:37595546
SOURCE Homo sapiens (human)

SEQ ID NO.: 41 transcript
PFKFB3 NM_001145443.1
Homo sapiens 6-phosphofructo-2-kinase/fructose-2,6-biphosphatase 3 (PFKFB3),
transcript variant 2, mRNA
LOCUS NM_001145443 4224 by mRNA linear PRI 21-JUL-2010
DEFINITION Homo sapiens 6-phosphofructo-2-kinase/fructose-2,6-biphosphatase 3
(PFKFB3), transcript variant 2, mRNA.
ACCESSION NM_001145443
VERSION NM_001145443.1 61:224282148
SOURCE Homo sapiens (human)

SEQ ID NO.: 42 transcript
PFKFB3 NM_004566.3
Homo sapiens 6-phosphofructo-2-kinase/fructose-2,6-biphosphatase 3 (PFKFB3),
transcript variant 1, mRNA
LOCUS NM_004566 4553 by mRNA linear PRI 21-JUL-2010
DEFINITION Homo sapiens 6-phosphofructo-2-kinase/fructose-2,6-biphosphatase 3
(PFKFB3), transcript variant 1, mRNA.
ACCESSION NM_004566
VERSION NM_004566.3 GI:223941849
SOURCE Homo sapiens (human)

SEQ ID NO.: 43

SLC2A1 NM_006516.2
Homo sapiens solute carrier family 2 (facilitated glucose transporter), member 1
(SLC2A1), mRNA
LOCUS NM_006516 3687 by mRNA linear PRI 21-JUL-2010
DEFINITION Homo sapiens solute carrier family 2 (facilitated glucose
transporter), member 1 (SLC2A1), mRNA.
ACCESSION NM_006516
VERSION NM_006516.2 GI:166795298
KEYWORDS.
SOURCE Homo sapiens (human)
Control sequences

SEQ ID NO.: 44

ACTR3 NM_005721.3
Homo sapiens ARP3 actin-related protein 3 homolog (yeast) (ACTR3), mRNA
LOCUS NM_005721 2728 by mRNA linear PRI 20-JUN-2010
DEFINITION Homo sapiens ARP3 actin-related protein 3 homolog (yeast) (ACTR3),
mRNA.
ACCESSION NM_005721
VERSION NM_005721.3 GI:34452698
SOURCE Homo sapiens (human

SEQ ID NO.: 45

NDFIP1 NM_030571.3
Homo sapiens Nedd4 family interacting protein 1 (NDFIP1), mRNA
LOCUS NM_030571 3599 by mRNA linear PRI 05-MAR-2010
DEFINITION Homo sapiens Nedd4 family interacting protein 1 (NDFIP1), mRNA.
ACCESSION NM_030571
VERSION NM_030571.3 GI:188595693
SOURCE Homo sapiens (human)

SEQ ID NO.: 46

RPL37A NM_000998.4
Homo sapiens ribosomal protein L37a (RPL37A), mRNA
LOCUS NM_000998 434 by mRNA linear PRI 07-MAY-2010
DEFINITION Homo sapiens ribosomal protein L37a (RPL37A), mRNA.
ACCESSION NM_000998
VERSION NM_000998.4 GI:78214519
SOURCE Homo sapiens (human

SEQ ID NO.: 47-49

SLC2A1
forward primer GCTACAACACTGGAGTCATCAATG,
reverse primer TGTCTGGTTGTAGAACTCCTCGAT
probe CCCCCCAGAAGGTG)

SEQ ID NO.: 50-52

RPL37A:
forward primer TGT GGT TCC TGC ATG AAG ACA
reverse primer GTG ACA GCG GAA GTG GTA TTG TAC
probe 5TG GCT GGC GGT GCC TGG A -continued Gene ACTR3
ACTR3, Gene ID: 10096, NCBI Reference Sequence: NC_000002.11

SEQ ID NO.: 53

Gene NDFIP1
NDFIP1, Gene ID: 80762, NCBI Reference Sequence: NC_000005.9

SEQ ID NO.: 54

Gene RPL37A
RPL37A, Gene ID: 6168, NCBI Reference Sequence: NC_000002.11

SEQ ID NO.: 55

Items

The following items represent preferred embodiments of the present invention

1. Method for determining the oxygen status of a cancer of an individual comprising the steps of
   i) in a sample comprising cancer cells
   ii) determining the transcriptional expression level of at least one gene selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.: 7), PDK1 (SEQ ID NO.: 13), PFKFB3 (SEQ ID NO.: 14), KCTD11 (SEQ ID NO.: 8), ALDOA (SEQ ID NO.: 2) and variants of any one of said genes,
   iii) correlating said transcriptional expression level of the at least one gene of ii) to at least one reference gene, and
   iv) evaluating the oxygen status by comparing the correlated transcriptional expression level of iii) with the same correlated transcriptional expression level of the same one or more genes of ii) of
      a predetermined reference sample comprising cancer cells characterized by a high oxygen level and
      a predetermined reference sample comprising cancer cells characterized by a low oxygen level.

2. The method according to item 1, wherein the oxygen status is evaluated by calculating the difference (D) between the correlated transcriptional expression level of iii) with the same correlated transcriptional expression level of the same one or more genes of a predetermined reference sample having a high oxygen level and a predetermined reference sample having a low oxygen level, where $$D_i = \sum_m \frac{(y_m - z_{im})^2}{W_m}$$

wherein m refers to the mth gene out of the genes of ii), i is the 'low oxygen' or 'high oxygen' reference sample, z is the mean expression level of the reference sample, W is the calculated common variance and y is the transcriptional gene expression of the sample comprising cancer cells, wherein the sample of i) has a high oxygen level if the distance (D) between the sample comprising cancer cells and the high oxygen reference sample is smaller than the distance (D) between the sample comprising cancer cells and the low oxygen reference sample, and wherein the sample of i) has a low oxygen level if the distance (D) between the sample comprising cancer cells and the low oxygen reference sample is smaller than the distance (D) between the sample comprising cancer cells and the high oxygen reference sample.

3. The method according to any of the preceeding items, said transcriptional expression level of ii) is determined by quantitative PCR (qPCR).

4. The method according to item 3, wherein said transcriptional expression level of the at least one gene of ii) is correlated to said at least one reference gene by subtracting the geometric mean of the cycle threshold (Ct) values of each of the at least one, such as three, reference genes from the Ct value of the at least one gene of ii) giving ΔCt, transforming the expression value of the gene of ii) to fold difference relative to said reference genes by calculating 2-ΔCt, and log 2-transforming the fold difference giving the gene expression value (y), wherein the Ct value is defined as the number of cycles required for a qPCR fluorescent signal to cross a threshold chosen on the basis of the baseline variability.

5. The method according to any of the preceeding items, wherein said at least one reference gene is one or more of ACTR3, NDFIP1, and RPL37A.

6. The method according to item 5, wherein said at least one reference gene is ACTR3, NDFIP1 and RPL37A.

7. The method according to any one of the preceding items, wherein said sample is a biopsy.

8. The method according to any of the preceding items, wherein said sample is formalin fixated.

9. The method of according to any of the preceeding items, wherein the cancer cells are hypoxic cells.

10. The method of according to any of the preceeding items, wherein the cancer cells are planocellular cancer cells 11. The method of according to any of the preceeding items, wherein the cancer cells are squamous cellular cancer cells.

12. The method according to item 10, wherein said squamous cellular cancer is selected from the group consisting of squamous cellular cancers of the head and neck, skin, esophagus, urinary bladder, prostate, lungs, vagina, and cervix.

13. The method according to any of the preceding items, wherein said cancer cells are are squamous cell carcinoma.

14. The method according to any of the preceding items, wherein said squamous cellular cancer is head and neck cancer.

15. The method of item 14, wherein said head and neck cancer is selected from the group consisting of cancer of the mouth, lips, cancer of the nasal cavity and nasopharyngeal cancer.

16. The method according to anyone of the preceding items wherein the transcriptional expression level of at least 2, preferably at least 3, more preferably at least 4, even more preferably at least 5 genes selected from the group consisting of ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6), BNIP3L (SEQ ID NO.: 5), BNIP3 (SEQ ID NO.:4), EGLN3 (SEQ ID NO.:

7), PDK1 (SEQ ID NO.: 13), PFKFB3 (SEQ ID NO.: 14), KCTD11 (SEQ ID NO.: 8), ALDOA (SEQ ID NO.: 2), and variants thereof is determined in step ii).

17. The method according to anyone of the preceding items wherein the transcriptional expression level of at least ADM (SEQ ID No:1), ANKRD37 (SEQ ID NO.: 3), P4HA2 (SEQ ID NO.: 12), NDRG1 (SEQ ID NO: 10) and/or or variants thereof is determined in step ii).

18. The method according to anyone of the preceding items wherein the transcriptional expression level of at least ADM (SEQ ID No:1), ANKRD37 (SEQ ID NO.: 3), P4HA2 (SEQ ID NO.: 12), NDRG1 (SEQ ID NO: 10), SLC2A1 (SEQ ID NO: 15), P4HA1 (SEQ ID NO.: 11), LOX (SEQ ID NO.: 9), C3orf28 (SEQ ID NO.: 6) and/or variants thereof is determined in step ii).

19. The method according to anyone of the preceding items wherein said variant is any nucleic acid sequence at least 95%, preferably at least 99% identical to the nucleic acid sequence of said gene.

20. A method for the amelioration and/or treatment of cancer comprising the steps of
   a. obtaining a sample of a cancer from an individual
   b. determining the oxygen status of said cancer by a method as defined in any one of items 1 to 19,
   c. selecting individuals having a cancer characterized by low oxygen level
   d. administering a hypoxia-modifying agent in a therapeutically effective amount in said individuals, 21. The method according to item 20, wherein said cancer is characterized by low oxygen level.

22. The method according to any one of items 20 to 21, wherein said hypoxia-modifying agent is selected from the group consisting of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidin kinase inhibitors, CA4O OXi4503, DMXAA, nimorazole, MISO and DORA.

23. The method according to any one of items 20 to 21, wherein said hypoxia-modifying agent is selected from the group consisting of as nimorazole, misonidazole and doranidazole.

24. The method according to any one of items 20 to 23, wherein said hypoxia-modifying agent is nimorazole (4-[2-(5-nitro-1H-imidazol-1-yl)ethyl]morpholine).

25. The method according to any one of items any one of items 20 to 24, wherein the method furthermore comprises the step of subjecting said individual to radiation therapy.

26. The method of item 25, wherein said radiation therapy occurs as one or more fractions.

27. The method of item 25, wherein the hypoxia-modifying agent is administered prior to or simultaneously with said radiation therapy.

28. The method according to any one of items any one of items 20 to 27, wherein the method furthermore comprises a step of administering an additional compound 29. The method according to item 28, wherein said additional compound is anti-proliferative and/or anti-neoplastic agents.

30. The method according to item 28, wherein said at least one additional compound is a radiosensitizing drug.

31. A method for amelioration and/or treatment of cancer comprising the steps of
   i) obtaining a sample of a cancer from said individual
   ii) determining the oxygen status of said cancer by a method as defined in any one of items 1 to 19,
   iii) selecting individuals having a cancer characterized by high oxygen level, and
   iv) subjecting said individuals to radiation therapy without administering a hypoxia-modifying agent.

32. The method according to item 31, wherein said cancer is characterized by high oxygen level.

33. A pharmaceutical composition comprising a hypoxia-modifying agent or a pharmaceutically acceptable salt thereof for treatment of cancer 34. The pharmaceutical composition of item 33, wherein said cancer is characterised by low oxygen level.

35. The pharmaceutical composition of any one of items 33 and 34, wherein said hypoxia-modifying agent is selected from the group consisting of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidin kinase inhibitors, CA4O OXi4503, DMXAA, nimorazole, MISO and DORA.

36. The method according to any one of items 33 to 35, wherein said hypoxia-modifying agent is selected from the group consisting of as nimorazole, misonidazole and doranidazole.

37. The pharmaceutical composition according to any one of items 33 to 36, wherein said hypoxia-modifying agent is Nimorazole is (4-[2-(5-nitro-1H-imidazol-1-yl)ethyl]morpholine).

38. Use of a hypoxia-modifying agent for the manufacture of a medicament for treatment of cancer.

39. The use according to item 38, wherein said cancer is characterized by low oxygen level.

40. The method according to any one of items 20 to 30, the methods according to any one of items 31 to 32, the pharmaceutical composition according to any one of items 33 to 37, and the uses according to any one of items 38 to 39, wherein said oxygen level is determined by the method as defined in any of items 1 to 19.

41. The method according to any one of items 20 to 30, the methods according to any one of items 31 to 32, the pharmaceutical composition according to any one of items 33 to 37, and the uses according to any one of items 38 to 39, wherein said cancer is planocellular cancer.

42. The methods, compositions and uses of item 41, wherein said cancer is a squamous cellular cancer.

43. The methods, compositions and uses of item 42, wherein said squamous cellular cancer is selected from the group consisting of squamous cellular cancers of the head and neck, skin, esophagus, urinary bladder, prostate, lungs, vagina, and cervix.

44. The methods, compositions and uses of item 42, wherein said squamous cellular cancer is squamous cell carcinoma.

45. The methods, compositions and uses of item 42, wherein said squamous cellular cancer is head and neck cancer.

46. The methods, compositions and uses of item 45, wherein said head and neck cancer is selected from the group consisting of cancer of the mouth, lips, cancer of the nasal cavity and nasopharyngeal cancer.

SEQUENCE LISTING (55 sequences)

SEQ ID NO: 1 - DNA, 2282 bp, homo sapiens
ctggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 2 - DNA, 17245 bp, homo sapiens
cctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 3 - DNA, 3551 bp, homo sapiens
cagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtgagattcgggctcacagagcccgagcttttgtcctgcaggctcaagcttctagattcgtcttctcgttaatgcggggacggaccactgggcgctgcctggtcagagctggttgtgaagggcggggaggtttccagcccggaggggcgcgggactggacaaaggtgggaagggtgctggatctgttctcttcctgcaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggtaactaggtaactgttgctgtgtacagccgtcccctccaacccagacacacacaaacatttctcagacgccaagagttgtttcagctgttaaaaacatgtctatagcagcgatgtccaacagaaatataatgcaagacacagatgtaatttaagagtttttttccagtcttgatgtgaggacatgagaaatttgaagtttttaagtagccacattaataaacgaaacatgaaattttagtatttgacccaatttgtccaaaatgttatcagttcaatatgtaatcaaagcaattgctgattagatattttacactttcttttattctgtcttcacaatctggtgtgacagcgtatctcaaatcagactagccacatttcaaatactctagccttaagtggctgttgactatcatattgaacagcacagatctagtttatttcaaaagaagtaattgctacattaccaaaagtctccctgcagcaattgaaatacttaggagctatgtccacaagcattctaatttcctaaagagttttcttactgtagtttgcatcttccactgaatattaaagcatggtgaattttaaattgtaaacttttctggaagaactctttttatttgcttacattttaatgtatgtgcatatggctacacgtttttatttatttgagacggagttttgcttttgtcgcccagactggagtgcaatggcgcgatctcggctcactgcaacctctgcttcttgggttcaagagattctcctgcctcagcctccctagtaggtgggattacaggcacgcgccaccgtgcccggctaatttgtgtatttttagtagagacagggtttcaccatgttggccaggctggtctcgaactcctgaccttaggtgatccgcctgcctcagccttccaaagtggtgggattacaggcgtgagccaccgcgcccagccacacatttttattaatgaaaacggtatgaaaaagcaaactaaaagaactaatcaaaaataaaaagcttttgcagcttaccgaggaaaaaaacaaaaataaaaagcttgaatttaaaaattcagtccaaaggaggagatttttagaaggttccatactgaaatgaatatgcaagcatagtacatttctatgtttcaaattagcccatggagttggctatccctaatgtaatcactaaaagtatctagaagatctaaataaaggaatgatcatttcagagcgtatgctagaatgctgaagttataatagtccactagttacttaattctgcatttctgaagtgttgcacttgcaaacgattatcagtagtgtttttaattagaagagatgttgatgcaggtttatatgtatcaaaaacacatgacttcttagtcttaaaagtgactaagacttcttatttctgaaaacaaacccaaaaccggaactgagaatgaatattaacaaaataaacccacgaaaagtttttggtgttctctgccaaaaaaaaaaaaaaaaaaaattccctgtccagtacaatgcagttctaactagcttccttaaatagctaatattaaatgtcactcatcaactttcacaaaaagtgtttttgggagactctaaaatgcaccatcttaccttaaggatgttttaggagaagctccactacacaaggcagcaaaagttggaagcctggagtgcctaagcctgcttgtagccagtgatgcccaaattgagtgagtatgaaaacagtggcttcacattttatgttttcttggattaaactaatcagactcctgaagcttagttacatgtgcttttaaaaataatgcttgcgtaattgataatttagtgttaatcatttaaatgttaacttaggttgttggtgctatcgaataatactcagttcgagtaagtaaaaagtcagatcctgagcaatcagaggtgcaattttgttcattatgactgtattctacttcagtttcggttcaggaaaacccattctatagttcccattgactacctttgggtactcatacactgtattaaacatcagataattctaacattcattcagaactggaatgcccgctctatgctggattctgttagttgctgaggatacaatagtgaccaaaaatgcaatttccttatgcatcctttacctcttctgttctgcaaccaacatttgtatgagcccaaaattcccttgtaagatataaaaaaaaagacttaagttcaatgtttcatttcactccgtttttatcctgttttcagtttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctggtaagtaactcagagctgctgcttttttcctcccgcagtgatctcttgtttgcatagcatttattattccatttaatactgacactcgtatttctagtagtattgtttcattctcattaacattttagtactggttatacttaccagagtctagagaccaaaaatgggactgcatggtggaagtttggggataaaactctttttaaaaaaaagtttttaatgttaacgtgtttttaaaaacagatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtcta

SEQ ID NO: 4 - DNA, 14232 bp, homo sapiens
ctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggtgaggcggaggaggcggcgcgggagccgagggggcgcgggggggaagcctggggaaggccaagagggcgccaaggggaggttgccggggaggcctagggggcatcgcgggccgggcgaggctgcgccatcctccccttccgtacccacccctcctgcgggcatgcggagcccggggcgtggggaccccgcgtactgcccggggttcgcggcctcgccactcgggcgggggttggcttggacccgggtcggaccgcacgggaaagccccgattctccagctccgcgcgagctagaattccacctggaggtgaatctgcgtctcgcagttggaccgaacagcctcaaagtccacgttgccctccgcggtctgtagttcagaccagtattggttttaatgaccaaacaccaaggcgtggcaagtggcctgttatgagctttaattttgttattaatgtttatatccatggtgactgttaggatttcctcaagggtgaacgcggagatgggagggggttacagcgtttttaaaatatggcattaaatgggcatgttccaatttcactagagggtcgttccaaaacaaagctttaaatgacttacgggttaagaaaacacaagcaaaaggacgctgcccgtgcagcactcagtcgttacagcctgcctaatgcccgagtagaggctcgctgtgtgcccttggctagattcgcaagaccatccgttcacgcagcgggaaacgcaggcccggggtgcaggacttgccccacgcacagccgggtggcgtggagacccaccccacccggtgggtccgcgtcagagtccagacgagcctttgctcagggaagcgggcactgaagccgccttcccagggtccctagggccaaagcctcggaggagggacctggtggcagctgacctttgtgttctttgaagccagagtttactaagcaaaattagcatgtaaataagcttgggaaaggactgctgaaacctctgacagtgaacttttaatcttcattgagagtttttaaaaccatatattcacataaatttagtgagttgctaattttattacaaaaaaaaagattttactaggcaggacttagttaccgtaatatattgaataatatatatatatacatatgaacactacaagctttttttttttacctttttttttttttaagagacggggtctcactgtgttgcccaggctggtctgaactgggctcaagcgatcctcccgcctcggcctcccaaagtgctgggattataggcctgagccaccaggcgcgcctggcctaaaaccatattctttaaaatcctgtaattcggatttttcctcttgaaatttaaacattggctaattactattttgaaatagattaagaggtgttttcctatcttttgtcataaaataaagtccaagggatgtttttataaactctttgccataaaatcacccattttccggttgtgaagccgcgttactcctgacattgtgcgtttcactgtccggctgggatctgggcgctgggaggtggagggggctccggggggctcggtcctctctccaatatgtaacttacacaggctgctgagtcattggcagtgcaaggcggccagcgccggagttacgagatttttgtttttctgttttgtttattctataaaaagatagttacccgcggggtggatcccatgtaggcgattccttgggccgccctgagtgtccgcgcggcaggacggggccactgtgggctcggcgtgggcggggttggccggtcccgcgggctccagctgcctgcaaatccgggacggagcggtggctcaggcagcgctcacctctgcctgtccgatttcactgccccttgttgacctcggaacagagaacaatgggagccttgcagccagacccacggatggaagcagcaagcactctctcctctgagtgtaccctctggggccaactgcttttcctaaagagttaatggcaaaatgggctgattctgttcctttctatctcttgatcattctagctaaagttgttgactcgcaggatgctcgtatttgtccttttccttttttttacaagcccagtcttactcccccaggctggagtgcagtagcacaatcattatagctcactgtagccatgaacttggcccttttctcctagacatgtcactgctaacatgcaggagaggtaggattctgtgacgagaccgtgtcacggtggcgggggcatcacttccttgaaggacccactgtcttcaccaggagggcatcagttcagtaaagtgcatgcccatttactctggagggccgtgtttaataatccaagccctcacctcttcacccactgctgtgtctgcaactggcagatggttctctctcttgtcagaggcaactcaccatgggcaaagttgtatgaggggaaaagatgttttctacttattttggagtggagttgtagcattgtgtgctttgagacctgaaggggttgcagacatcgagattctcgtccaagacttgcatttcatagatggtcacaatgaggttctagaggtggagtgaaagataaggctggcaacaacacttaaggagaagccaaggtctctgcatgaggcagcagtgggatacctggagcccagatgcctgaggctgcgtgcaataggccctggagggtcctggaggagaggaggccagaggtcctggaggcaacaggaaggtggagggaaacgagccccgttggaagccagggacctgatttacctacccagctgacttgatacttgaaatcttttgtcaggcgggtctcttttgttctctccccactaacctgagaagctttaaaggtaaaacagcaatttcttagagcccacctcccctggggaagaagccctttgtatggttttggggtgctagttccctcgggggttcacagctcctctgcttcaggttttttttctgggatgctgcctccctctgttctgacatttatcccagagctttttcaatctatttgcctggattccaccccagcatcccaaatagtcactttcagagtgggctgaggctaggcttttggagaacaatgaaaaaacaccacaggtgattctcccttcatagccagagttgaggttgtcaccccaggttagggcatagggtggccttgagaacttggccctgtgtttactccacgtggggctcgtggctgtggcccatgaatccatgttgaggaatgggacccagggagttgccctgggacatacagagggcagtgaatcgaagggattccctggagtctgtcactggagggagaactgctttgggcacctagaaaagctggatgtcagatgattttttttttttttttttacacaaagtgagaataagaaatggattaagaactcttgttggactgtattttgtctctgaggcagacctatcagttttctttttgtactgtgatataaatatttatagtctaggcttttcaaaatctcatctaccttgatataggagggaggtaagatttactggctgtgtgtcttgttagcaatgtaaattataagtgagtgaggagggggaggaacatgagagggacgcgaaatgagattaggaaggagggcttttcttgcagcagcaacagcagcacctttccgtctggggcctaattatactacagtgatttgaagtgtaaactgcttgtgattatgagcaagttttctaaggttattaagcaaccttactgtaagcccatctttctttgaaaaggtgaacgatccgagtggagaactgtaacacgtgagtagatacacagcacgctccattctccaggaagtgccttcctttcctacgcggttgctgtgggttaataataaaactcctgtcccttagtaaatcattcctgggaatacagcttttgggcccaaagtcattagccatggacaatctggagtgagttttttttccttgtttcctggatttttaggtcctttctggggtgatgtttaaaaagcactgctttggttcgaatgtgttcctccatgttgccagtgggatggtagtaaaaggtgggcctttaagaggtggctcggccataggggctcctctctagtgaatgggattagtgctctaaggggctggatggagggaggtgggtccctctgtagcctcattgaagggatgaggcaggaaggccctcagccgacaccagatgttggtgcgtggatcttggacttcccagcctccagaacagagatcagtttctgttcgtaaatcactaagtctgtgggattctgttgcagtagcgcagaggatgacagagatacacttgtctctccttcatcttcctctccctgttgtcttcagcctgccccttgtgtgatagattacagtatgtgtttggtcttgaccctacctacttcctggtgcagagcacctaaacccctggggcttcctgagcagtgtcttttttttttgtttgagacacagagtttcgctattgttgcccaggctggggggcagtggcatgatctcggctcactgcaacctccccctctcaggttcaagggattcttctgcctcagcttcccgagtagctgggattacaggcgcccaccacgcccagctaattttgtatttttagtagagacggggtttcaccatgttggtcaggctggtctctgactcctgacctcagatgatctgcccgcctcggcctcccaaagtgctgggattacaggcatgaaccgctgtgccaataagtgtcttaagcatgtttattaaagaaagtaaaacagtaaaaagatggtgactccataggcagaacaacctgaccagtgtgtgcgttattcataaagtcaccctattagcagtgtactccaaaagtgctccttggttaaccatttttggtgtaagttgtaaggagccccttcagaatacactgctaatacagtggctcaagggtggccccaggatagttacttgaggtagaaattcccagggcagcccctcctaggaggggaggggactggagatggagatgggggagccatgaggtgcgggtagcatggttggggttagggttgggacatgtggggtaagtgggagtctggttgcagagagtgtggttggggttagggttgggacgtgtggggtaggtggggatctgggctgtatgtcatttccatttgtctgccctggaattgtttctggtaaactgataaatgtaagtaaagagtttttctgagttctgtgaattgtagtaaattactgaacctgaggcaggtgtgtgggatcccctgagtaggtagaggcactggcagaaatacgggtaacctggacaccccattctctgcttgcatctgtgggaacagtcttgtgggctccacactaagtctaggtagatagaatggaattgaatcgttggacaccccggtggtggtgacttggtgtcccacatttgatgttaagagtggcatcagagaagagacaccacaccttcaagttgcatttgtgttccatatcgtcagatagctgaacaacactttagtcaagtaaattgaagcaggcccagaatctgaatactgtagattcagcggagaaagacagctggccaaaacagaggctgtggtgccgttctctcaggggcaggccatggctagccggccgcatggcatcttgaaccgcagagagggaaggagggctagtgaacatcagagtacttggcaatactgtctggtcagatgagcggcttcaggaatggtgtggtctgtacatctcagaaggcaccatgtagcctctgccagagtgtggggcagactggcctgggcctttctcctccattgagctccaggctccgagacagaccctggcttgcctttgtattagggatgtgcttcgtgtaggccaggacatgaggcaacgtgagaggccaaagagaacaatcatgcgttcatttgaaaatttgtgtgatcatttcgttagcagcttactgggagactgttgatggcataagttgcaaatccacttttccttcctgggccttcggtttgcttttttctggttaatatgaaatagactctgcaacaagtggcgtatggagcctaggccagccctctttcaggagagatgcctcgtgtgtgtggaaagctgtgcacctgcctttgcttccagcgaacatgacggatgaagaggctgctcctttccccctaattgcatggtgttattagtgctgtgttggtttaaggacagtcagcagctcagggtgattattctgcttactaaaattatagtgactgcaaaaatgagataattccattgttctcgtccataagtttccctgtcttttgtggcctgcactttcctcccactgcactccatcctccatacgctaccagaggaagctcctaccagatttgctttaaataaataaacctatgacacaaagtagagagattatctggggcccagaaatagacgtgtgcctatatgcacgcttgatttctgacacaggaagcagccagcgcagagtgaggcgggagctgtctgcagtaaatggggcatccgtctcacatcaatgggaaaattaatccatgtagattttggatctaaatgtgactgtcataacagtagagctgtgtgaaaataatagaatagaatatctcagctcaggaagggattgctgcatttgactgaattaaaatcaagaacttctgtacatcagaagacatcagaagtgaaaagaacaagctaccgagggaaagttacttgcaacatatttaaatgcagaaaaacatatatctagaatacagaattatcccagaattgcacttttagcagtaagggaacgggagcagcgttccagcctcagtttctatttataatggtgacatggaaaaaatactgctggatgcccacaaataagagaaagacagataatagaaaagaataagagattcgaagaaccagttcaaaaaagatgctatccagatggctagcaaacttgtaaaaccgtcttcaacctcgttagaaattatataaatgcaaagtaagccacacgatgcaagtcatagaggctgggcatggtggctcacgcctgtaatcccagcacactgggaagctgaggtgagaggactgcttgggcccagaagttcgagactagcctgggcaatatagcgagaccccatctcctaaaaaaaatagccaggagtagtggtgcatgcctgtagttccagttattccggaggtgtcagctagaggatggcctgaacccaggagtttgagattatagtgagccttcatcgtgccactgcaccccagcctgggtgacaaagcgagactccgtctcgaaaagaaacaaaaaatagagcttaaaccttttaaagaaaacttcaaatcccttaagcttatgttgacattagtgttgttgttgttttttttaaagacctctttttccaaataatagcctttttcttataaaagctcactgcaaggaagtattctaattggattctgttgactcagcagagttattggacattggcttggtataaagggactgcaagagctggacagatacatggtctcagccccagggggcttccttcctgtacccagggagtgtgtgcgtggacagtcactgccatgagagtgggcagagggatgtcttcaagtcggggttgagggatggttcctggtgtggcaccattgctacctcttggaaatggaagggcaggctggttagatatcaagagcagattccagagtgggtagagaattccatctgcgcccctttttttgtccccatcaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacaggtaggcgcgcatcaacaagtgtatgtgttacagtgccgatgtcttcagtgggtgacagtcacagctggaagtgcccgtgtcacctctaggacagtgggctgctgttcgcctcgggccgcgttctggactggctcctgctgcagtccgtccttatataggagcctcgccctctttggggatgcagtgacctgggacttagtctgtggggagccatgttcaagtcatcagtaggcagcggaacagccacaaaccccactctgagaaacgcactcacgcgcctcagcggggctgtggtcgcaggaggagcggtccctggttagcagtacttctgagtgactccaaggtagagtggccgacagtggtcaaaggtcgcgtgcccttgagagctgtgcaacagacccagaccgtgaaggcggcaggtgacaaagccagctgcttgccagttgcccctgcgtcttctctggaagactggctagctcactcctgtcgtgctcagccaaaagggctgaggaagagtttggctctggcaggtgctgggtggaagggaagacgcgtacgctgactggctagagcccctcatcacggaggcggttcactgcctttggggtttgagcttctaatgatagaatgttcacatgatgttctgtttttcccattctattcacatcgccaagcccacctcgctcgcagacaccacaagataccaacagagcttctgaaacagatacccatagcattggagagaaaaacagctcacaggtaagctggaaggagaatgtgcagttgtaaaagtatttgtgatctgtttgtacaggaaacggttttaaatgtaattgagcacctcagagaaaagtcgggctttaagggtgtttcctgctttaaaaaaaacaaaaaagcgaaacaaaaaaaccaagaaactgtgggtgggaacatccacaagcacatgggctggacactcagctgagcgggggaggcgccgagtgggacaggcagcgggggcctcctgtccctccctgcctgccatcagggatacaccggaaaggaggaagggctccctggtggctgcagcctagagaggagggagggaccattggaaggggtggcagtgagccagctactggctggtctttcctcgtggttgctggttggacagtgagtgggttttaatatttgcatgctgtgtgggactcaggagttacccacggggccatctaaggccatgtggccactgtggctgtgactctgaggtgtcttcctcattagacactcactacctgccggaaattacaccctgtgcctttcctagcattagtcctgagctaactggtgccggagcagtgtagcattagcggctgatcagcctgataatttagtgtaagatcactttttcttcttttttaaaaaagttttttttgtagagacggggtctccctgtgttgcccagggtggtcttgaactccagggctcaagtgatcctcccaaaatactgggactataggtgtgagatactgtgtccagcctaagatgacttttctgttaacagctattgaatgggctttacagagcggccttcagcattgttgtgaaagcggagtgagtcttagaggaaaaagtgtacctggggttattgccttggtgtactatcgttctcccttcctactccggcacagatagggttcgaggcagtgatcagtactgtcttgctcagttatatctggcagtgccttaccttgctgcagatgagatgcgcgatgtgttttcttgggtgttcgttgctggtgagaactttgacgacggactgtgttctgtattttggaagctctgtgaggaagcatggccttccaggcagggttagtagctgacccttccgtgctagcgcttccctcaaggctttcttcaccaaggaaacaaggagtccctgttacccaggctttctcagggacatcccctggccccactccgaggggcagcatgatttcgggagccccaggagccctggctgtgggtgtgtgggtgcatccagggcgtgcggcctgctcctgggcacttggggctgtacccagcttgggtgtacccagatgtttggtgggtttggggagctatattcttgagtattttcaattttatttctttttttttgagacagggtcttgccgttttcactgttttacacaaaacttcccctagttttaaaaggaattagatgttcaggtacagaattttgaaaatgcaaaaaagtagagaaaaacacttagactctcagatttaaaatcctctttaatgtttcgtgctgttatataattctgaggatttggccgcagctgtggttatgtggacatttctgccttttccctcctgcttatcccggaagcatcttgtaaacctgctcactatacagtgtcccttccttcgtcatgtccctgttttgagccgttttcggctgttttcattttcttttcttataaccagtgctgccgtcaccatctttgccctcatgtcacgtgacttccctaggacagtgtttgccgctgtcagtacccccagaatctcacagtgaaccaaatgtatttacgccctgagtggggctcccccagaggtgatctgtccctggaggcggcgagcgtgctgtgagccgggagtgcggcgcggcccggggaaggcccccagccccaggactccccttggaccacggtccgaggcactgacatgtgcctctgggctcttgaattgagcctgcggatctgaagctcgggtgggagctgggtgctttcccgtgtcacgtgtggtacactgatctgcctttaacattgactttatcttagtctgaggaagatgatattgaaagaaggaaagaagttgaaagcatcttgaagaaaaactcagattggatatgggattggtcaagtcggccggaaaatattccccccaagtgagtgtgttctcagtgtcacgggggcaccccttgacagaggacacatcagctgacacgtttcttcccgcctcagggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggtaggtgatgtgactgtgtgactcctgtcatggcatgtcgtggggcgattctgggttgcagtgatttattcgtaacctgtttcctgaagtccagatcatcagttacagcttggtgcattttcacaaacacccacgtagtcactgttcaggtccagaaaccaccagcctgcagcccccaaaggccccagcacaggcgccctgtggtgctgctgtctggcctgacgagtctgcctgttgctcactgaatataaacggagtcaaagcagggcttcttaggtctgacctctttgtcctgtgtgtaggtgaaagcagtctcatttctgtgtagtactgtggcgggaatgcacccagctctgctgtaggtggagggtctcagttacctgctgtacttcctccagacaggactgttgttctagtaactctcagcaatgaaggaaccaatgcagtctccgactttactggcttgagtttcgctcttgttgcccaggctgagtgcaggggcgtgatctcggctcactgcagcctctgcctcctgggttcaagcgactctcctgcctcagcctcctgggtagctgggattacaggtgcccaccaccaggcctggctaatttttgtatttttaatagagacggggcttcgccacgttgcccaggctgatctcgaactcaagggatggctcacctcggcctccaaagtgctgggattacaggcgtgagccaccgcgcctggcctttcctggctgcttatactcactcaccctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctggggttgaaggaaacgggataaaagccactgagtttcctgggccgggacctgagcgctgcccgtgtctccacctcgccctcccgtgtgcgtggctttctcctagctcttgggcacattctcacgtcccccccataacccgtcaccttcatttctgctggtgcttttgggagtcagacctacagactgcatcagcatcaccaggcagtttgctttctggagccttttccagaactgtcaagcagactctgggggcaaggcctcgggatcctcattttaaatacaaggtttaagcccttcgtttcaggatggatttctgcagccactacttcccagctactgtccttcgtcctgcccgggttttcagagcctgatgctgccactggcgacccacaccccctcagctgcttttcagaaccacacgataaaatctgccccgaaagctgctgcagcactgtctgcgctcacagtgcccaccacaccaccgcccacaggccaggccagccaggcttccgattctgccctttcctggagacccatcctcctccctccgggagtgatgcccgctggtcagctggagcgagcctctctattgccgaaaagccttttctgacactcctgcatctttagtttgggacatctctcccactaccaaacttaaaccacatgagggcaggggcttcatttttaagcagttggctttggtgaggctggtggtgatgaactagcaacaccatcttgccctggtaggtgacttcccccagcactgagttggaacaaagcagaagctttctgtgtggaaacagcattcggtttggtgatccttctatgtaagaatacgatctgatgttttctaagttaattaatacaaaatacatattgataaaacactagataaaagatcacagatagattcattacaaaatttttataatgggtataaaatcaccagtccccttgcataagctctaaccacagtgagctaccctgtttcagctgtaacacagtctcctgtgaatcacaagatacattaactactgataatttttctgtgaaggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 5 - DNA, 30122 bp, homo sapiens
cgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagtgagtgcggggccgaggctctgtgaaggggatgggggaggaggagcagccccggccgccgccaccggcgcggcgcgggaggcgggaggagaaggcagctcattggctcaggcatgggatgtccaggtgactgacagctcccgtcccctgtcaagaggaggggcgcctgccttgctccgggcctctctgttgcctcctggggtcttgggcccggggccgtttgggctcgcggtccgggagcggcgcgggtagcgcggatccccctggtgcggggggtggtccccagcagcggagccgggcggggcggggcgggggcgggcctggggggcggggaggccgggtgggcggagcgggccgcggaggggacgtgggccgggatggggacgtgcggcggggacgccgggggatggacgcgcgggagcggggcggggcgggcggctgccgcgggacgtgtcggggatcaggtgtgcggggctcgcgggcgggcagcgtctggcgggcgcgggagccccccagcgagcattcctttgttgccacacgtttgtcaggaaaattcatttgctcgtctagggttggcttcagtcacgtgtggggtgagaggctgtgccttgcttctcctttttccttttttatttttttattagatttctcgaagttgcccaagtgatttttttttttttaaagcgatgggttgtgcgcccagtaaagctgagagcagcctcctgaaccacccaagattgcacacgtcagggagtctggggccatgcatttaaagaaacggaattaaaaacgcactcgggcagttgaaagttaacggacgaggctgatagacaacccaggccagggtcttttcataacattccgctgcccagacatcttgtcctcagattgttcctagtcgtgagaaccgggagccttcttggaagggttcttgcctaacctttctttaattcaactcttgggaaagaggtaatgggagcagtgagcatatggccagatgaagtcttttcaaaaccacttggatgcttaaaggtcatgcagtatctttcgtaagagggaggtgcttccagtgtggcctgaagattattttagggaagagagtttcagccctcaccaggtagcgatggagtttggagattttaagatggatgctgctgctccaggttttgatgggttaattcccaaaacctttaagtgtcatatattccagaatgtaagatggttatattatttcccacagtaaattaggatgaatgtatgagtctttaaacgttacttgtatcacatattcctatgcaattttaagttatttgcccatgtttagcatactgtcttagattttagaatgggaagaaacttcagagctagctaactgcctcctgttgtttgcctgtagagaaacaggtctagagtaaatggccttgtccaagttcacaaccggctgggagcaaagcagaggttctcatgttcagcctgtctactgctcttttgaggacatttttttttttttttttttttttttgaggtagagtctcgctctgtctacaacctccgcctcccaggttcaagcgattcttctgcctcagcctcccgagtagctgggactacaggtgcctgccacccgcccagctaatttttgtatttttagtagagacgaagtttcgccatgtagctgggattacaggcgcccgacaccaagctaggctaatttttgtattttcagtagagagggggttgttggtctctcaccatgttggccaggctggtctcaaactcctgacctcacgtcatccgcccgcctgggcctcccaaagtgctgggattacaggcttgagccatcgcaccggcttcttttcagtggtgcagaacctcctgctggtgtgtgtgtcttattttgtcagtgtgttattctacctaattgacaaaggtggccaacctttctgtttctttttagtattgtttcttaattgtacagttttcttatgagtgaagatacttggtaggtgtacgtgatttcactgaaagcaaagggattttcatcttcctttgaccctttaacaacaacaacaaaaagggctgagccaggcagggcacgatggctcacacctgtcatcctagcactttgggaggccaaagcgagtggatcacttgaggtcaggagttcgagaccagcctggccaacatggtgagagaacaaccccctctctactgaaaatacaaaaattagcctggcttggtgttgggcgcctgtaatcccagctattcaggcggctgaggcaggagaatcgcttgaatccgggaggcagaggttgcagtgagccgagatcacgccactgcactccagcctgggtgacagagcaagactctgtctcaaaaaaaaaaaggggcgagggcgggggctgagccatatgtcattgtttatcttggtgtctgacagacctatgaggagtttgatgtctttggccagtcggttcctgcttggctgacatcagctcttacagaggtggaagtacactcagcctgcatgggacatcaaaatgttgctttgggacatctgctagatagaaagtattttgtgtgggatagggtgagctttctgaaaagcttttagatattgccatatttaattactcccttcttgcctctcactctgttcgtttttttagctcattacacaacactgtactgaacaaaacaagaagcctcattgaattccttgaagtgatttttgggcaatgggcaaaacaacttattcaggcatctagtactatccaaattgctgataagtcgaaggactttgttgggtaaagttgcacaactgaaaaacaggagaagaaatgtacagattatcttgcgtttgggattttatctttggttcaggggtcaaagcagggtttcaatagcaaattactgaagtatttgaatagtgaagtatttttgtgatttttttttaactttaccgctgtggagagactgttcactttcattaaaaattacagggcaaatacccaaactccttccaagtcaaaaggatgttgtccagtttgttttattgttaagaaaactatcaacttccttaagaatgtttgaataagattcaatagggccgaataaggaaaatcaaagtagtagtgtaaatcgtagtataattcttgttgttgagaagtatagccttttttttcttttcaaattttcttgttcttttttgttttttgttttgttgagacagggtcttgctttgtcacccaaactggagtgcagtggtacagtcatagctcatggcagcttagacctcctgggctcaagtgatcctcctgcctcagcctcccaagtagctaggactgcaggtgtgcacccccacatccagctaattattttatttcttgtagagttcgagtttcactttgtcacccaggctggtcaccggctaacttattttttgtagagatggagttttgctttgttgcccaagctggtcacaaactcttttttttaaatagaaacatcttcaagcacaatgtccttgctttcttgttatgaagagtgctcttaaggccttcatggattgtcactgcctcataataatgttttgaatacctacgtaacttgtatgtaaatacatactgctgcaaaaagaccaacttttcaaaaatttatttatttatttttttatttaagaagaatgccagtaactcttgttggcctggtctggatttcagcatcaggttggcctggtctggattcctttcaataatgaatgaaaagctttgaggaaagaatgtaaatataatgaaatttcaaaagagttacatgtgggccttgaaaagttagggggaaagatgaggagaaatactcttcattctctcctccccttgtcccaaagctcctctcttcttcttcttgcaagaggattgaactagtgattataaaactgtaaagattatacaacatacggcaatgagtataatcacaattattggaccacccttcacagtctattatgttagagaacggagaagcattcacagaagtttctctgaatctcttagtcattcccaaaaacccaaaccagaaaatatctcatgtcattgtatgttatgtacaaattggcataaggaacagctcttagtttgtaaagtcttttagataatggagaaagcttccagcttttagttttcaagcttgatcattaggaggagaattcactctgtggttgttttctactttgtgttgcttggacagcacaaacctcttatctagccttgtttcctttccaagtaaaaagggactttgtgaggattggtagagttagaacactaagaaattctgaggctgtaaatcaggaacaaatcgggtgatgggaaacagacgtgttgttcatctattgaggaagacacatttgcttttttatgtgttactcaaaagattaatatgtagcctcttaatgcctgtgtacataactttctctgtaccactatgtatttccatagatgatatttttgaaagagaattacccttaattaattaaaggaaatctacacttttaaggctgttaatacctattgtcaaattattctccagaatgttcactgaagccctaattgtaataacaaagtattagaaacaaccatctcagtagtagttaaccattgccatttagataatggttaaagtatggtatatctttataaaagatgagatgcaatgcagttgttcaaaagaatgaatgtcagtatatattgatagggaagacatctgaaaaacgacttacagaatatgtcagtatgtgtgtatggtacagttccatttctttataaaaacaaaagcaaaaacagacctatatttcattgacaaaaactctgcaagtctccatgtgaaactgtcaaaagtggctcctttgggagtaggaacgggaggttgggagagatgttaatttttaattttatgtactgatgtttacgttttctaggaacacatttttccagtaaggaatggtttttctatgatatagaatataattgtagtagctaaaactttcttagggacctttcttattgttctgcgtgctatattcatttaatcctcctaacaaagtcttcgaggtagatacagttattatctctattttatagatgagaaaactgaggcacaaagaggttaagtaccctgtgcgagggtaacagctataactgagagtgggagcctggcttcagtctcagcccctgaccacactataccagtgtatcccaagtacaaattgtccgccttaagtagaaatgctttcagttatgattcagggtgtggaggccacagcagagatcacttttactaagcttttctaggtatgtctctttcaggttccaaaagtatatattggattatgattgcttatgtgtttttaatgaagaaaataggatccagacattgatttgaaagtccttcaaaaaagtaaaaaccaggttgggagcagtggctcatacctgtaagcccagcactttgggaggctgaggtgggaggattgctgaagcccaggagtttgagaccaacctgggcaatgtagggagaccctgtctctactaaataaataaataaataaataaataaataaataagtcgggcatggtggcatgtgccctgtagtcccagcttcttgggaggctgaggtgggaggattgcttgggcccaggaatcaaggccgcagtgagctgtgattgtgccactgtactacagcctgggtgacaatgcaagactgtctcaaaagaaaaacaaaagtaaggaccagaaaacctgatattgtttgttacacccttttttctcttcgattgcctacttcaagtgaatattaattgtattttagggaagactgacttccacagagacctatctggaactcctggttccttacctctgcttctgtcagagcagctctgggttttggtttgttactattgtacacattaggcttctatacaagaagaactggtcccattggtttaaaaataagtttgaaaatcctagaaacagtgagagtcagaaaaaaaaactgtttttatatacatattctctcccccaccccctttctctccagttgaaatatgttgcagagctctaaatttagggatgcttttggcgtatttcttatacactccagaggcactcgagataaattatcttcaatgttagatctctcttagctttgctagttgtatttgttaatccattttgagttctctagcctgtgtccattttatgtgtgtatagaatgaggccatggagatgttgtacaactgtgtcgtttggcagcagagtcctaaggaattggtggtgactatgggatggtggtagccactggggctgcctcaaatggaaaggaaagggttctaagtatttataaaagaaaattctagtgtataactgagcatcttctatttaccagcacttgatactactaaatcgtcacagcaccccggtgttattattatctctgtttacaaatgaggaagctgaagctcaggtcacacaggtagacaggaagtgatggggtcagattcccagctaggtctgccttggagctttccttcttgtgagggtgatgttcagttcactctggaactggtgtagccatcgccacatttagagtgcattttagagtttgagccagttttgatgattttacttcaacttactgatggaactccttgttcatccctggaactctctaacacttctgctgggagtttagagggatggccacaccaagctgcttgggtacattttctaaaacaaaatttattgtaagaaatggaaattatgaacaaaatataccactatctctttttgctgtgaagttaagtttattggctactgttaacaatttatttacttacttacttactattcttttgtagagacagggtcttgccatgttccccaggctggtgtcaaactcctggattcaagcaatcctggtgcctcagcctcccaaagtgctgggattacatgtgtgagccactgtacctggcctcaactcttgttaaaattaaagcaccttaatacgtttagcaaactcatcagaccaataaatattttcaagatgtatgcagaattaccagtggcacatcccctttttctgtggctccaccccttcaactttttgtccaagaaaacttttcgtgtttgcctgtagctgatgtgcagttgtttctgctcccaaatcaacagggtttaatgaaaaccctagaaagtagaaacccgtgggagagaaaagaaaaaagacaagttcacaaggtatgtttagtgtataaaaaaggagaaggactagaaagcctgagatacaaaggaaatgaagaaactaatcagtgagatagagataaagcttttttctgaatttttagcattattacctgatttagttaaccagctgcattaattttatgctcctgatttgtgcacaaattgaaatttttgctattggatttaggttccctctctaggagtttctcagttgtttgcactaagtaggatatagttgctaacttacttagatgaccttttatgaaatttgtaggtgatatatttatttcatttctggagcagatacagctgagcagcttaggtagactatgaagaaagtgtgtgtgtatatatacaccaactaaaatgttaaaggtaaatagcctaaaagtagcaatttttttttgaaaagcaacctgagttttcagtagagtgttattataaaccaagctttacccagagagaaattgactgaaaaacacgttttctgagatgttttagagtttgagctgtttctcagttgatggcatgagctatttcaggaacagaactatatagatctttagacttttattacttcttatttattttcttcagaatacttttacatttggtttgaggagagtcagaattcttatctggattcaccatgttcacatctgtgtgcacatgacagatttcagttctgctgtggttaacttatctgacttgtccaacaggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacaggtaagtgagacccatgttttggtggaattcaggaaacaggtgggttacagggctcattcactctaggaaaaatctgtttgcttaaatcttcacttagcaaaatatgcctcctgatatattgtagtataatatatattgcacagatatatattgtgtttatatgagacagctaattgacaggtgcttcagtgcccactgtttttccccagattgtcatttttcttacccagattatattgtttctagcagtttatcagtttaaaattcagtggcataaatgctaatttatagaattaatctgactttcccccattttcctttgtgtccctgtgttacagatcacagactgttcttgaattagttacctctgtatatatgtgtcttcccttctagatgttgacgttgcaaagggcaggggccatgtttaatttttattaccttcacagtaatggtgctggcacgtagtagacactcagtaaatgtttgattcataggaactgcaggttgcttcacgttatagcaatatttgcacagttggaagcaccaaccaaggtctgtaaagatagttttgaagtctcctctgctttctcaggggatgttttgtttcagacctcatttttctatatttgagctgaagaaactaattacatggattaaggactgcttatggtgaaagagtaagaatacaacgagatatgtgtgtggaatgaaaccaggtcattattttttagtataaacttttctgtttttttttttttttttcagaagggctagatattaaatgacatttaagaaattcttgtttcagtgacagctacactgttagcattatggggcactggatgaccttctgggtggttgttaactgatgttaaccatttagaaaatgcaaatgcacgggaagcagattaaggaaatgtaaacagtgactatttttaggaatgcagtatggatatgtttcttcttaacatttttgtattttgtaaaaattgtgtatattgcacatattattacttatcagaagaagtgaaaaaaaggagaaatgagttaaatcatgtccaacttcctgagtggcttatgatccactaatgttgccaaggcagcgggggactggtttgttggctctgtggcacactgtgcacccccgccacccccgtgtcatccctgacttgtccctgtgcttcttagagcctgggatggctcttgtcataagcggaaccagagcagatggctctcttctgaacagcttgcccttgattccagtagctacagcattagtctgtctttccgaatgaagatttatatttatattatggaacttgctgatgggtttctcaagttttctgcttgttatggcctgtcaacaaggctttcactctgcgttcaggtgtgtgggccttgatcattgataccatggtgtccatgagcctgttgttcacatggtgctgtcaatgagcagagaacagtcacctgcttacctgtctgttcatcttacttcatttatggtgcagttttacgtgtgactgaatatgccttcaccctcctatgatcatgtttaagtttaggttgccatgaggaggcatggcaaatgcttttgaacactttcgtacccctcatcttatgtctctccaggccctagattagtggtcatctttcagagaatggctagaactcgagtcttctgggatagcctactaacacgctttaccattgaggagtgtcttcaaaactcacatcatctgaattgccatgcgtctctatatgtgaaaagtaattggaaagtgtttcttgtagggggaaatgttttagggttgttgggtatcagtcctagagctgatttatgtatattttcaacttaaaaattattccatagaaatatttgtgttgccgcaggggttgttagctgggaaccccagtgtgttctgctttgcctttcaccctgtcacaggggttttcaccttgacggcacactagattcacccagaagcttttaaaaatggcagcacatggactgcatctcaagaacttctcattttggttgacaggggcagggtagagacgtcacaatattttaaaagctccccagccgattctaatatgtgccatgggtgaagctctaatgcattccaaattgttaggaggagtaaacagtttagagaagaggttggtaccagtgtgaagaagcatatagaagcagagcaatgcttccataggattcttgactttgtcaccctgactgccttgacctggtcacggctatgtaaggctgacccttaacttgatgtgtagctgtgaacccaacagttatgagcacaaagatagtaaactgaggccagtaggagtgcccagttcgggttgactcctgtgctagttcaagacaaaaatttcctaaatatatatgacgttggtttgatacagaaccagcttttctgttttcctgtccccatttaaaaatctcctatgtcaattatactagtctaaaagactcctaggcctaatctgtctgataaatttctgacgatcttatttctgagtcagtctcaccaacgtctctatacattaattaacattatatacatactcttgataactttaatagttaatatctattcttttcagcaagttaagccccaaatattttttatttctattttagattttgggggagggtttgtgtatgtagtgaaggatccccagtgactttcagtttttatacaagaaatcattaataaagctaagaaattaacttagcacattctgttcatctcttgtatcaagtgcagtttgtgatcatgttgtttttgtctaaaaacttatttgtaaatttttacagttctaagaatgtattttgtgcaatcataaaggttttatattaatatataagttatataattcactctgaaatatctcaaagcaaatatttctgaaataagtaaaatagtggttctcaaagtttttggtcattacatacctttacattcttaaaaatcattagggaccccaaaaaacttgtttgtgggtttatatattttgatatttactatattagaaattaaaactgagaaaatatatattcattcaaaaataatacattttaacataagtagcattttttagtgaaaatacctattttctataaaccctccaagttaataagaatagtggcattgttttacacatttacaaatctctaataccaagcttaatagaagacagctggttctcatctgtgtttgcattctaactgttgtgctatcacacatcatgtagcctttggaaaattccactatacacatgggagaatgagaatgaaaaaggcaaataaatcctactagtattgagaaaggaactgtaacctcaaagaccctctgaaagcgtctttgagaactaccttatgcactttgagaactactggtgaattatttaatgatgagggaactttgagaaaaagaactctgaagttcctgaatttgaagattattttacctttagtggacaaaagagtaaatataagagaatgtgacagtttgtgtctgtagatagtatttcctttgcaaatttatcattttgaaggatttcattactactgaaaaagtgcagaacattttgggagtaagaatgctcaatttcatttagccttttaatatcacataaatttttcttgtatagggttatgatatattctctgatttgctttttcaaagccatactgctgtaacttttaattttctaatttctagtagagactaagtcatttgacaaagtgagaattaaaactaatagctgaattccttctcttctagcccttcgccacaagaagatgggcagatcatgtttgatgtggaaatgcacaccagcagggaccatagctctcaggtgtgtcggggggattctgatttacagtaaacaattaagaaagatgtaaattctctaagtatattttgctaaaataaatgtgaagacttttaggaatagtttgaagctattattgagtttctgattttggaatttatttaggatgatatagttcttgtcgcactcctttacaactaaggattttgggccctgtcactctaaacgaattggaaaattcttgtccataataaatcatgccaatactccaggctagtttcttgagtgtataagtagaaaaagactgagatagatgctttaagaccacagaatagggaggagccaagatggctgaataggaacagctccggtctacagctcccagcatgagcgacgcagaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgtgcttttcagaccggcttaaaaaacggcgcaccacgagactatatcccacacctggctcggagggtcctatgcccacggaatctcgctgattgctagcacagcagtctgagatcaaactgcaaggcggcagcgaggctgggggaggggcgcccgccattgcccaggcttgcttaggtaaacagagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaacggaacaaagctggatggagaatgattttgacgagctgagagaagaaggcttcagacgatcaaattagagtgagctacgggaggacattcaaaccaaaggcaaagaagttgaaaactgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaagtggactaaattctgcaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaatattagacagatcaacaagacagaaagtcaacaaggatacccaggaattgaactcagctctgcaccaagcagacctaatagacgtctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctagcatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacaaaaaatgatactacaaacacctctacgcaaataaactagaaaatctggaagaaatggatacattcctcgacacatacactctcccaagactaaaccaggaagaagttgaatctctgaatagaccaataacaggagctgaaattgtggcaataatcaatagtttaccaaccaagaagagtccaggaccagatggattcacagccgaattctaccagaggtacaaggaggaactggtaccattccttctgaaactattccaatcaatagaaaaagagggaatcctctgtaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccattttctcagcccaaaatctccttaagctgataagcaacttcagcaaagtctcaggatacaaaatcaatgtacaaaaatcacaagcattcctatacaccaacaagagacaaacagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaagataatttacagattcagtgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactataccacaaggctacagtaaccaaaacagcatggtactggtaccaaaacatagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctacacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacagttatgcagccaaaaaacacatgaaaaaatgctcatcatcactggccatcagagaaatgcaaatcaaaaccactatgagatgtcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcaggtatctagaactagaaataccatttgacccagccatcccattactgggtatatacccaaatgactataaatcatgctgctataaagacacatgcacacgtatgtttattgcggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggagcggggaggggggaaggatagcattgggagatatacctaatgctagatgacgagttagtgggtgcagcacaccagcatggcacatgtatacatatgtaactaacctgcacaatgtgcacatgtaccctaaaacttaaattaaaaaaaaaaaacaaaaaaaaaaacctaccagtggaggtacaaaataaaaaaaaaaaaaaagaccacagaataaatgaagatgaaggttgtattagaactagacatgaagacttttttttgcatctgaaatcaaagcagtggcttttgagataaattttaaatttatctaaattatgcaggattccttcaagataaatattgtttactaggagttgacaatgttggaaacatagatggatatagtattaaaatcttacaaatgtttgtgttataagacttaaaatatggtaagtatataactgtggctaatgatttagaatactcatagccagcctttaactttattgatatgtaagatcacctaaaagtgtcattagagtacaaattcttgaggacgggaaccattatctttttctcctgtatttagggtgcttgaaaaatgtttaatgaacctttgaatgagtcgcaacaaaaaccttgttttgtcgggttctcactattctgtgtcctgggcactagaaatattttgtgtgtcttagatccacccagtattctttctgtttccaaaggccacagaattcctctatactttactatgctctatttttgcttttctctgaaatgtcgaaaatctttggattcaacacaaatttattttatgatgatgagctttatactgtagagaagctcacaatagcaggctgtcgtatataagatgatctgactggagcatttgaattgctggcttatgtatgtcagtttggccacatgcagtaagctatagctgatgtagaagaaagcttacaaagtctccatagcagaaagtgtaccacggaatccaggagagaaatcgaattctttgccgtggtctttcctgaggaggatttcttcaatctatatcaccttttatacagaaagctttaagtttagattagcattttccaaaatgtgttttcaagaacatttgttcaaaggtcaaataaatggaaggtaatgcagccccaggttcccccacactctcaccttagtagtcgcatgagtaattctgaccagttcctgcagtaaagaaattatagtttaagctggacatggtggcacttgcctgtagtctcagctacttgggaggtggaggtgggaggatcccttgagccccacaagtttttgagtccagcctgggcaacatagcaagactctctgtctctaaaaaaaagaaaaaaagaaatgggtttaattaaaccaaatgtttcccaagcttatttgaccttagactttcttcctcttctctgcatacgtttttcccttaagaacttaataactccgtggagcactgtggtaagtgctttcctggctcatggagttgcagatgtgcaatcaggcttaactcaatattgaatgtacatggaattctagagttgaatgcatctaccctggaattccaaaggaatttttgaaattcaggaaagaaaatgtcaggtttttggcctttggtaggtttgccagtgttgatcccttctcaggaccaaatccctaaaagagcataggctatcatcaagaggaggtacttactttatgttgacaatcagatcggtcagtttcaacaaagggaagagtttggaaagacagcctaacccctgtgagagataacagttgagtaggacttaataagggagctgtcagcaggtatagtttaaactttcaaaaacctttgacattgcctttttttaatggaagaaacaataatttaaaaattaatttctttaggatttgggaaaattgattttcttcctgaataagaagaaagtttagggttaggaaacttaaaaaagcagttaaaggactgttattgtacttgatcttatagaatgtttttatatgtgtttataaggactatatataattttcaagcttttctaagatgaggaagtaaagtcactaacattaactagatatgttctaggtactcagtttctttttttttttttttggagacagcgtctcagggtcttgctttgtcacccaggctggagtgtagtggtgcagttgtagctcaccacagacttcgattcccggctcaagcaatctttctgcctcagtctccctagtagctgggactacaggctcacactgccacgcctggctacttttttattttttttttgtatagacagagtctcgctatattgcccaggccgttttcaaactcctggcctcaaatgatcctcccatgtcggcctcccaaagtgctggaattacagacatgagttactactcccacctctcttttaatgttctcaatccagtgaaagcaatgatattatccccatggaccagtggaaaaagtgaggctttgtactaattacttatctaagatcacaaagcaagtcactgttagagccaggattcaaagcaggtctgagtctgtggcccttgttctttctactgaactaagtaaatgaattcgattgataacaggagagctcacaaagccatgagaatgaactgaaaaatgtctgctgagttatggtatggggaatctgcctaaggcagtgtgcacttaggaaaaagaccatgaaactgcttttcggatgatcatcctcaagagtctcagttttgtatcagaaaacagactgtagattgtttcttcacttgatcttagccaaaagtccgagaagcgatatagattatttattgaagacatttttgcattgtgtttctgggaccaaaaatgccagcacaatgttgagtgttactgaaaaatgatccaaacagaaaatatcctccatttcctgtcttgtaaaactgtgatttttatctgtacatgaatcatggtatacagcttaatatccatatttagaggacagagtgaccttgaggtaaaccagagaaggaaaacttaagtgatcagaaaacaaagaactccatgtgagagaacaggctagaacgatcagaatcttctttgtttttgttttttgtttttgagatggacctcactctgtcaccaggctggagtgcagtggcatcggctcactgcaacctctgtttccaggtggttctgctgcctcagctgcccaagaagctgggattacaggtgtgcaccacaacgcctggctaatttttgtatttttagtagagacagggtttcgccgtgctggccaggctggtctcaaactcctaacctcaagtgatccgtccacctcggcctccctaagtgctgggattacaggcatgagccatggtgcccagccagaatcttctttgaatagatgtaggtatagagagaggattattgattttaaaagcacaaatcttacgtaattagattaagtacatttttaccatattctggaattctaagaattggaaggcagtttaaaacctgaaagtggcaaatttaagattaataaaaggaagcacagagtggtagtgaatgaggaaagcttaccactcttattcttaaagtattgtaagttgggaaacttatggagttcttttttgttttgttttctttttaaaacacttgtccagagataactttgcttcattcaactgagaaaattccatcctcatgaaaaaaaaaattagagcgtgaaatcttactgcgtttcattctgtcagaaattatgaaatattaacttgttaaatctttgagcaggtttaaagaaagatctgtgaggccaaagcaggaaactaaacagaagcgacctgcagtgtgttgagtatagtcagatattgtgtgtacaggaactgatgtgcaagtaaattgtaacagtttattgtttttgatttgggatgatttcagtgttactccaaagagccaactcatgattctgagtaatctcaatagccaatggaaggagcttaatcctaaatgctacattgtgtcattcagtggaatttgccaagttcagcagaactagataagattggtactaacaagagcagcagaacgcacaggggttttactttgccctgtctgaagctccttcctggggtagctgtttcacagagaactagacctgtcaagagtcatgtgaatatgtcagactctgcatttcttagctacctactgaaaagaatgacagctttggtcattcttttgagtgaatcctagtcaaacaaaataaaatgtcaaaatgcttcttagttttgagacccctgggtttgggatcatagcatgacatcccttaaaactgactatgaccaggcacggtggctcacgcctgtaatctcaacactttgggaggctgaggcgtgtagatcacttgaggtcaggagttcgagaccagcctggccaacatggtgaaaccccgtctctacgaaaaatataaaaatttgccaggtgtagtgccaggcgcctgtaatcccagctactctggaagctgaggcaggagaattgctagaacccaggaggcagaggttgcagtgagccaaggtcgcgccactgcactccagcctgggtgacagagcgagactccgtctcaaaaagaaaactgaataaataatactgaataaataaatatcatttttaggactttttcattccttttggttctattaaaaggggagctattggaaatgttaattgttcttggcctgaaactttaggttataataagcaatttttaaaagtcacattttttattttatttgatatgacacatgttaaattctgactcaacttattatagattattcccaaaaacttttggctaacatagtttcgaaaccttggaaaatgtttgtatagcaatttgtcctaaaaatataatctccttccagagagtaaaccctggtgcttaacagtagggcctctctatacagtattcctgggtttgaatactggccctgctatgtactggttgtggaaccttaggcaagttatttaatctatgtctcagtctcctcatctgtaaaatgggattttaataattatttttatagggttatttgttgcaaggtgaaagttaatgcatgtggctgggtgcagtgtctcacacctgtaatcccagcactttgggaggctgaggcagggaagatcccttgagcccgggagttcaagaccaggctgggcaacatagtgaaacactgtctctttaaagaaatacaaaaattagctgggcgtggtggcacacacctgtagtcccagctacttgggaggttgaggtgggagaattaattgagcccaggagttcgaggctgcagtaagctgtgattgcactctggcctgggtgacacaggagaccctgtctccagaaaaaaaaaaaaaatgcatgtaacatgcttggaataatatttgcccctttaagtgctcaataaatactattatttatttcctcatcacatctctcacttatttttgttttacttctcatcattttatttttagcatatccttttatttccttttatttttttaattatgaaatttttttttttcttttttttgttgagatggaatctcactctatcacccaggctggagtgtagtggctggatctcggctccacctcccaggctcaagcaacctccacctcccaggctcaagcgattcttctgcctcagcctctcaagtagctgggattacaggtgcccgccaccatgcccggctaatttttttttgttttgttttgttttgttttttgaggcggagtctcgctctttcccccaggcaggagtgtagtggcgcgatctctgctcactgcaagctccgcctcctgggttcacgccattctcctgcctcagcctcccgagtagctgggactacaggtgcccgccatcacgcccagctaatttttttgtatttttagtagacacagggtttcactgtgttagccaggatggtctcgatctcctgaccttgtgatccgctcacctcggcctcccaaagtgctgggattacaggcgtgagccaccgcacccagcgtgtaagttttgtgtttttttttagtaaagacggggttttaccatgttggccaggctggtctccagcttctgacctcaagtgatccgcctgcctcagcctcccaaagtgctgggattataggcatgagccactgcacccggcctaattacgaaaattttaagtgcatacaagagagaataatataatggacctccatgtaagtattgcccagatttaactcttatcgaggtttttcatacttcccttagcattacatcccaaagtacagtcttatgcagttcctgtgctgtgcttagatatcccaacagtgaagctcactcaggttgttctgaagatattacatactctgatcttacattatttttcagcattttttagaaaagcaacatgtttgttatctaaaatttctgagacacaaccttatgagtttggtatcttttctgtctagatttttctttgtattaggaggaattggtcttcctttttttcttaaagtttgaattcttctttacagtcagaagaagaagttgtagaaggagagaaggaagtcgaggctttgaagaaaagtgcggactgggtatcagactggtccagtagacccgaaaacattccacccaagtgagttctcacatgtttcttgtcagtggacacagttgatctgcgcacgcttacaggcaatgggcctggtaatccccacgatattttcagcaaatgacatctgcctctgaatttctttctcagggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggtaagtaccggtcaactcctgaagttttttccattcattttatcctcttattttcagattgaagaaatgtatgtgaaagcagtttttattgctttactttcaatgttttagtgcaaataaggtgaacttaaaaaagtgggtgcacaattgttctacaaataagcatttttaataatagtagagtgtgttttcttatttgaaaataagatgtttggcctggtgtggtggctcatgccagtaatcccagcactttgggaggccaagatgggtggatgacctgaggccaggagttcaagaccagcctggccaacatggtgaaacccggtctctactaaaaatacaaaaattagctggccatggtggtacatgcctgtggtcccagctacttgggaggctgaggcaggagaatcgcttgaacatgggaggcggaaattgcagtgagccgagatcatgccactgcactccagcctgggggatagagtgagactccatctcggaaaaaaaaaaaaaaaaaagaagatgttcataataatcccctaaatgatcaaatgtaagcggactcctctgtgattgatttttctttttgggttttgttgtgtaatatttaatcttgagtaatttatgaactaaactaatctttagcatgtacattttgtggtcagtgcaaatacctttttttcatatgggaaaatacatgattacattgaatagttttttttaatgaaactggtaggttgattggtgctaattttttccttttttaactttgtagtattttcatttattttgctaaaatcaacctcatatttacgtgtaattcattagtttcttagccacatcttttaaataaattgctttttttccttgatttaaacaattgaggaattacacttctgaaagattttaggagttaaacagtagctgttaatttttttcaagacgtatgttgtgctctaagcatgcccagtgggtcattttcagtataagatatgcagaagatggggtcatcctttttcttccctttaaggagctcagcatattggagagagattcttagtcacgacctcagaaacttgcatacagctttccacacacccgtcttgtctctcttgggtgcttgatctgcttttgtgagggcaaggacagtaatcaacaaacagcaacctagaaggggtttgtgcagaaggggactgtgtgactgttgcgtgggggttgatgtggggcaggtgtaggagtttaatacattgctgcctatacagcagttcattgcccttaagcgattggtgtctataccttgccgtctctctttcagtcatcttcagattgtttgtcttggctgtaagtataactattgctatagatgaatgtaaaaagagtgtttaaaaagttcgttgctttaattgcactggaggtgaagctagttacatactttccttaacttcccttctgcttttgctgttgaagaggccaaatactttcttggcatgaaaaagtattataaggcccctaatccttaggagttattagtaagagctgtctttaaagcactggcagcttttaaggttttttttttcttttgtcctacatagagcaccagaataatttcacatattactatatttttgtgtctgaaatgtcagtagaaccttctgtccaccaaagaggaacatcttgaaggagttgggctgctttatttactctgtggagggatctgttctctctggctttactttgtctaatcactacccctttgctgtcgagccccgatatttaatgagtaaacaaactcatataaaaccagtttggccgggctggtgactggttttaagaaagtcagtgatgatttcacggtgtttggggagcggtacccacaaacctttagagccttttacaaagactgaagagttttaagtagagttcaacctgtggacaagctggtatagaactgttgaaacaggtgaaacatgatgcttctgcttcctttcagcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 6 - DNA, 25939 bp, homo sapiens
cttcccactccaacgctgggtgacattgagctcaccagcgccaccgtccccggcgaagttctgcgctggtcggcggagtagcaagtggccatggggagcctcagcggtctgcgcctggcagcaggtgagacgccggtcgggatatgggaggtaggggagctggcccggccgctgcgggtgggggaatcctgaagccttcctgggccccggagtggctccattccatgacgcactttctcggttcctcagaatcctacctacttagtagccatgtgggagggaactaggtgagcagctgctgataggcattggagactgcccgtgaattaccctcatctccatccacccagctcccaccaacttaactgcccacgcgcctacccttctccccacccccgtcctcagcctcccctgagctcagtctgtaaagcacctactatccctagacctcccctttacccatgcattcagctttccaccctaacctcccctatctattgctctccttgagtcttccctcttccccctgctccttcctctctggagtttatcccagaaaacctccagtctgaagtttccccactcattaaatgtctgattaggccaaggatttaggtcttagagattaataataattgttttcttaaaatggaggatacattacttttaaacacttatacaattaattgattcgaatttcttggaggaagtgtgtaattgaaggatctgcagtttgttttggtggtagacatttgtgtgatgactattttggacttaggtaatgaaagcttaattctttttttttgggagaaccagcagagccttggcatagtaggggttgagaaatcagagggcttgcattttgactcttttctgggtaccagagatcttttgttcaatggcacacactacattattaaaaagttgttaattaaatttttaaaggaaaaatagccccaaacttggctattcaaataatataaatatatattgtaatgtaaatgaagtaatgcaaaaaaaaagagtgaatgttgcatagtttcacaagtttgatacataaccttccccacctcaagattatcctttacacagcttatctagtgttccggtagagaatggactggaaaacatgtctcaaactagagagtattattatatttacttcctttaaaagcaaacacttcttccactaaaatcctcaatactatgatttcattgattttgtcagttttgttgaactaattcacctaaaatatcttctgtacatcctattaacattatgaagcttttcaacaaggcaagtgaaaggatcattgctctgtaaaaaagttaaaatggactgcatgaaaagaactttgacatcttggaactactttgacatctttgaactaatactgagtatattgtaagtagttcatcttcttgctttgagaatatatttatgcatcttgcataaatatatttttgcatctctgcaaacttctgatgtgtaaaaacttcactattgaccacttaaccaaagcagaattccttgagtgatttaagaacaatttattttacttcagatataaaatttttaatagcacactaaggatgttatatgagcagctctctccatatgatcttccacgaatgtctgatgctttgtgagcaactccgcaacaacctactacctttcacccacttcatagctaaatactttcatatacattattttgttggatggatttctcatagcagccctctcaggtaagtcttattcctcccacactttataaatgaagaaacataggtcagagatgacttgtccaggatctctttgccaaaaaatgttagagccaggagagggtaccctttaattctggaatttttgtgctttttgctgttgttcaagctgttcattcaggggctgtgcgtgtgtgaatttgtcatgactaattggatctcattaatctgaaatggaagagtcatgaaatgcagatttagttctgaaatgaaagtacaccttcatgtgcaaatggcttttcaagaaagaagactgctttaataagcagccttagccaaaggaatgaaagatcaaatagaaatgtaggctcaatgtggtggctcacacctgctatcccagcactttgggaggctgatactggaggattgcttgagaccaggagtttgagaccagcctggctaacttagcaagaccctgtctctacaaaaaaaacttttaaaaattagctgggcatggtggctcaaacccatagtctcagctactcaggaggctgaggcaagaggatcacttgagcccagaagtttgaggctgcattgagctataatacgatcatgctaccacattccaatctggacaacagagtgagaccctgtctaaaaaaaaaaaaaaaaaagaaaagaagcataatctaggcataccttacttatccagaatatttggaataagattctctaggtaagtgaaatttcagatgatcaaaacttaaccttataaatgatggacctttacttttgtttctgttggaaatctttggtatactcccttagcaaacaatatagcaaacataatgtaggcttttatgagctcgaatttgttgttttgtagatgtagttgtagatacagatcagggttgttaacttgtggtactggacacctccacatttgagaggtcctgtgaacttctcaaatttttatgattgtataccatttttgagagagagggtccatattttatatctgctactcagagcagttcatgctctttaagttaaaaagcactgatacagatgattaggaactaaatggccatttacccacactacgctgggtttcataagggtaaacactggctctgttttgtttttactcagtccttaccacttattggtgttcagttcatagtagacaggcaatacatattttttggatgaaggatgctaggaaatatcttggaacatgctgcaaatgtaaggtgagttttcacacctgttttctcctgaaagaataaaatagatataacttttaggatattgtatctttccacagaatgattattagttcaaaggaatggaatgaccttacaagaatgtttcttattgaaagaaagttttgctcccctaaactctgttgactggtcagatttgaaaatgaatttgttaccgtcattgttaccaatgtaatggactatgggctgccttccttttagtttaacccacatctcagagcattagagtagagaggtatcttagaagtcaggtaatttagtcctctaatttttacagatgaggaaacttaagggccaagaagggaatcagcttgccaaggaccacacaggtacagacctgggacatagccagtatcccctggctcccattctgattttatttctaccacattctgctaccttattctttttgtttgttcttgctaaccaaacctaaatgagaacgtacgcattttaactacccccacatttggctttacttattgctcctttccaggtcttgccaagtatttattgagtacacaatggatgccctgtgtgtatactgtgaaggctctaaaatgaatggactgccccactcctagggctgatttattgcaatgaacaaacaaacatatataatataccattggcttcaagaattctgagattcttgaaggctccattgaaatgaaggggtgtgagagtgatgtgagcacatgtaggggcggtaatgagttgtgagcacatgtaggggcggtaatgagtctgaaaaaggatatgagagaggaaagattaccttagggattttgatcaggaggcaataggaggtaaagtgtagtgtttggagacgtttgaaccaaatgaatttggaccaaaaaaaccttttagcaggagaagtaacacaagaaacatttctggaaaattaactcagcaactacataccagttgaattgctgctacctatgaagatattacagtaactgatgtgtgaggtgatgatggaaataacgaatatatttaggaagtgtcttgaagaaaggatgagtttggagatactgagtaaggaaggacttaaagacaagttttttaatgttgaggactacagaagtattgcctcattgtcagaaataagaaagttggaaaaataatcagaaacgccatcaaagatttgtgttagtttggcagagaagatggtgcattattgagtaggtttaggtggcactgagttataggttgtgagaggttgaagacctgagggcaaaggaagagtaaagttatggagataaagatatgggagcaattagtctggagttgatttttaaaacagaatggaggagtccttccagagagtagcacagaatagaagcaaggactaagccttggaggtgtgacatggtgtaaataataggaactgggaaagaagacattaaagaagattggtcatagaggttggagatgaagtgagagaatttggtggtacaatgtaaggaggcattgaatccttgtagaaagatgagatcagtcgaatcaaatggccacaaaaatgggaagagtagagtcagaagggctaatgatgagaatctaaaaaaatgtattcatgaccgggcacggtggctcaagcttgtaatcccagcattttgggaggccgaggtgggcggatcacgaggtcaggagatcgagaccatccttgctaacacggtgaaaccctgtctctactaaaaacacaaaaaattagccgggcgtggtggtgggcgcctgtagtcccagctactcaggaggctgaggcaggagaatggcgtgaagccgggaggcagagcttgcagtgagctgagatcacagcactgcactccagcctgggcaacagagcaagactccgtctcaaaaaaaaaaaaaatgtattcatatgactagaaagaggtcactaatgttggtagagtaattttagtaaaatgattggagaaggaaacattgtagcaaaataaagtgtgggtggtgaagtgaagtagtagatacatgccatttattcaatcatttgagctatgaaaaagaggaaataagaattttattaatagtacctgttgagaacaagtgaatgctttgtccaacatagtggaccttcagtgttattgtagagtaataagacagaattctcagtaactactagtagaagttactggagaagtagtcagcctttctggaaagtagtatagatggatagatagatagatagatagatagatagatagatagatagatagatagatagatgagatagatagatggaaacttaaaggggttcatacccttttacccttcacttccaggattttattctaaggaaataatcagaaataccatcaaagatgtatgtagagaactgttcattgaaacattacttataacactgaaaaattggaaagaaatcaagttgtagggaattactacattcagattatagctgtgtgtcgggttttatacagctattaaaagtattaatatcttggaaagtatttgtgacatagcaagatacagtattatctgattatgaaaaatgtatatgttttatgtaagtataggaaaggtctgaaaagaaatattaatgcaccaagttgttatccctaagtgctatgattatgagtgcttttatttttcttcacatctttttttaacttccaaattttctgtaatgagcaagtgttacttttatcatttaaagtttgttttactaaaagctttttacataacatggtgtgtaacaacttggtggtacaaaggtttttacatagtgagacccgatctctacaaaacaaatttttttaattagctagacatggtggcatctgcctgtggtcccaactactccagaagatgatacaggaggatcgcttgagcccggttcaaagttacagtgagctatgatctctccactgccctttaccctaggtgacaaagtgagaccttgtctctaaaaaaaaaaataagttttttagttttgattttaaagatgggggagataacatttggcaggaaaaaggcagtggaaaataaggataagtttggtacgacatccctcagcagagggattactacttaagaataaaggaagactggtatttcttcaagcctgcagggaaggatgagaaaacggatatagggagtctgtttctgtcacaaagcccaggtcaacagctaaggcctagagagtttcagatagacactctggggagtgggttgtaatattgattctctgattcccagagagttgtcatatctccagtcacatcacctatggttttctccaagaggaccttgaaagattctgagaaagaaaaagcatccctacctttcctcactgtctatcatggggttggaaaggatatttatggaaaggaggggactaccaggagagaagctggtacttcaaccagcctcaccctggctgaccactatagcctccagctagcaatgatatttctaaggcactggttttcagattatgggtcccccatagcagaagtttcaccattacctgggcaattgttagaagtgcacattctcaggttctgtccatactgactgtatcagttgggtccagtaatctgtttcacagggtcccccaggtgatttcgatagataaaaaagttaagaacctttactcttaagattagccgtttgccacccagagccttagagacagctgtgaggcttcatcttaacttcctgctagggccctggagacacagaattggtcagccagggacaagctgttaagtccagctagagggttaaagggctgtttttcttttggtttgtatgtttttaatcgtgatccaccagaggatggaaaatttctggcttggacgtctggtcaatatattctgtctctttgagagaaaacgaaggtcttagtaatgatattaaagtttgtttatgctttcatgttgttataattgcaaaataaaaaccaagaccacatcaaatacttcagacattttttagcgataactttttaaaatttaaaattttattttattttatttttgagagaaggtctggcattatcgcccaggctgaagtgcagtggcatgatctcagctctctgcaacctctgcctccagggctcaagccacccttctgcctcagcctcctgagtagctgggaccacaggcacatgccactgcgcccagctagtttttgtattttttgtagaggtggggtttcactatgtagtgataacatttttaaaaatatttttaaagcaagacctcatctttaaaaaaatatatttacattagtctattattctaatatctataataagataatatgtgtgtatgttttaatcagcatttatactgtagggaggtaaaagttattagcatacaatatgaagttgtagtaagaaaaagttgggagatacagtctgatctaggtgaacctctcatgtctccaagtccttaccctccataactacctcagtacctctctcacatcaaattctacttgtcttcccattattcattctgttctggccatactggccttctctttatgggctctagaatcttttagggtctttgcatttataattctttctgtttggaatattcttccaccagatagctgcatagctagcccttgcttcccttcaagagtgacattctcacagaggacttcctaactactctatgtaaaatttcatacacagcccattccaaacacatacttcatgtccccattgtttatttttttctctctggcacttagtatctaacatatgtataactttctccccagtagaatgcaagttctattggcacagatttttatcttttttatatattgcctaaaacaatgcctggcacataggaagtactttgttgaatgaattactccaacatacatcgatgtcactgatagtaggtatacatgttagcattttttgctttattatttctcaaactgagctagctgagaggcagtttgtcttctgttctcctaaactgcctttgttctataattaggaggaatgggaaaggacagctgtcttaggaaataattattgattctttttctgtttaaagagcagagtccttctagcttgctgccggttaaccttgttccttttgtaagtgcctgccaaaggaggaatgggatagcattgtgtgagatggggccttgtaggtcacattaaaccagtggttctctggggagatgaaaaagtcctggagatggatagtagtaatagttgcacagcagtgtaaatgtacttaatgccactgaattgtacacttaaaataattaaaatggtaaattttatgttatgtatatttaaccacatcttaggggagagaaaagcctaggttctcaaagtatagtccagaaccagcatagcagcatcacctaggaacttgttagaaatgcgaattcccagcctccattccagaactgtggatgcagaaactggaggtagacagcctcatgatttgtgttttaacaaggcattcctctgattcacaccaaacactaaaacactaaaatttgaagatcacaggatttaataattgtgtcttaatcctgagtgctatgaaaatctattgaagagtttcatagacttttcccatggcctcataactgcataattaactttgtcagaaatcctgaccacattaggggtaaaattgaaaagtgttctagaagttttatcaaagttaatgttttacataatatttcaaaaaaaaaataaacttaacagttagagagcctgctgtgtttcaagcatcttaccagatgctcccatatttgcttttccatttaaccctcaaatcaactttggtacaagaaacactgcattatccacattttaaatgaggaaacaagctaaaagcagttaatttatctcctttccactaggtggcactgatgttgtgtttgccagatccaggcaaagctttctggcatttatagccctagaaaacaaaataaatgaggccttttatgaaaaagactgtgtgccaggtaaccacaaatagagattccaacttctggtgtgtcaagagtaaggacctctgaaaatccatttttacccaaaagcaatgataacactgccagaagttggcagaagcaacttttccagaactctggaaaattaccaggcatttgtgacaatctgaggagcatttatccaaaaaaaaaagcctgaaatcgtggtaggacagcaagttttgtggagttttaacttgctttattcctgtcttctttcagcttcacaatagtcttgaaaaccaacagcctcacaaatcacagttactttgaaaaccagcagccttgcaggcactgaagaaggcagaatgggtttaagagttttccaaaacttccagctgcagagaattgttactatttgacttgtctgacagttcgctggaaaccccactcacagggcttatcttttttcacctgacttggagtttattcactgcaaacagtgttttccctggtgcatttgttgaaaataatcagcagcacttgtttgacataacatggagtgggtaacagctgggtcaaacaagaagctggggaatgagatgtccatcctgacatctggaaagctctgacatatttctagaatgtaatatgtgtaaggttggacacattttccaggaaaaacctgagaggtctctaagctctcacctcacatttagtctctgtccgagcacgaatggaaggtgtgttaggccagtctcgcattgctaaaaagaaatacctacgactaggtaatttataaagaaaagcagtttaattggttcatcgttcttcaggctgtacaggaaacatgatactggcatttgtcaagtttctagggaggccttaggaaacttacaatcatggtggaaggcgaagggggagctggcatgtcacatgtccagagcaagagcaagagagatcagggaggtgccacacacttttaaacgaccagatctcataagaactcactatcacgaggacagcaccaagaaggatggtgctaaactattcatgagaaatccacccccatgatccactcacttcccaccaggccacacctccaacactgggggttacatttcaacatgagatttgggtgggggtacagatccaaactatatcagaaggctaaggcagtgttgcagactgcctgcctgagggtagaagacatgccccaacatgcacacacagcccgtaggcaaacacttaataaacttaaaggcatttattagtctctccagttactagctgaccactaagataaccagacagacctctgtggccaaacacacaaaggatacaaggagagactatgaacaactctatggcaaaaattacataaaccagatgaaatggacacacttttagaaaaagaaaaattatcaaaactaagtcaagaaaaaataaaatatctgaaaagtcctgtaacaggagattgaactagtgattttaaaacttcctgcaaagaaaaagtccaggcccagatggcttcaattgtgcattctaccaaacatttaaagaaaaaaatagaattaatctttcacaaattcttccaaaatacaaaagaggagggatcacttcccaatacatttgatgaggccacattatcctcataccaaacccctcccaaaaaaatctcaagaaaactatagacccatatatatcccttaggaatattgatgcagaaatcctcaagaactgctacaaaatgaatccagtgacatgaaaaattatagactgatcaagtgggatgtatgctaaaaatgtaaggttaggactcctgactcaacatcattcaccatgttaatagaataaaggaaaaaaacacataaccacatcagtaaacacagaaaaagcatttgacaaaatgcaactcctcttcattataaaaacactcagaaactatgaatagaaaggaacttcctcaacctgataaagggcattaaatgaaaaacccacaactaacatcggacttaatggtgaaaggctgaatgcgtttcccccatgacatgacaaggatgtccattttcaacagacatttctgttcaacactgtacttactggaggttctcgttagggaatttaggcaggaaaaacaataagtggcaaaagaagtaaaactatattcccagataacatgatcatgtatatagaaaatcctaaggaatacacacacacataccctgttagactaaatgttgaacagttttgcagtatgcaagataaatgggcaataaataatgcaaacatgaagaaaattccatttataatagcatcaaaaagaataacgaagtttaaaacgtactctggaaattgcaaaaacactactgaaagaaattaaagaagacccaaataaatggaaagacatcccatgttcatggtttgagagacttaatatttttaagatggaagaattcctcaaattgatctatggattcaacacaatccccaacaaaatcccagctggggtctttgtagagattgacaagctgatcctcaaattcatacagaaatttagaaatttaagggaccctgagtaggcaaactaatctttaaaaagaaaagccaagttggatgactcatacttcctgattaaaaacttaactacaaagctgtaataattaagacagtgtggtgctggcataaggacagacatttagatcggtggaatagaattgatagtccagaaatatactctcatatttacagtcaattgattttctatatggcgctaaaacaactcagtgcggaaaagaacagtcttttaaacaagtggtgctgggagaactggatatttacatgccaaagaatgaatttggatccttttcacagaaagtatactagtataactcaaaatggatcacagacctaaatgttagagctaaaactataaaattcttagaatataggagtaaatctttgtgatatcgtatatggcaccaaaagctcaagcaataaaagaaaagatggataaactggacctcacccaaattaaatttttttgtacttcaaaggacatcatcaagatagtgaaaagatacccatggagtgggagactatatttgcaaagtacatatcagataaggaaagaactcttacaactcaaaaatgaaaagacataaccctacttaaaaaaaaataggcagaggacctaaatagatgtttctccagagaagatatgcaaatggccaattagtacatgaaaagatcctcattattactcattagataaatgtaacttaagactacaatgagataccacttcctacctactgggacagttataatcaaaaagaataacaaatgtgggtatggatgtgaagaaattggatccctcatatatggaaatgtgaaatgttacagccacttggaaaatggtcttgtaattccttaaatgattaaatggagaattatatcacccagttgtttcaccccttagtatataccccacaaatgaaaatacatgttcctcaaaaacttgtacacaaatgtttataacagtattattcataatagccaaaaagtggaaaccacccaaatgtccattagttgactaatgtgtaaacaaactctggtatagtggaataaaatttgtcaataaaaaggaatcaagtgctgacaaatgctacaacatggatgaaccttgaaaatataagtaaaagaagacagtcataaaaggccacatgttgtatgattccatttatataaaatgtccagaatatgtaaatccatagagactgtgacttttagggttgggggaaggaggaaacagggaatgactgctaatgtattcaggatttctttctggggtgatgaatgtcttctggaattagtgatcaatacacaacttagtgaatatatgaaaaccaccaaatttcacactttaaaagtgagttttatggtagggaattatgtatcaataaaagtattattttaaaaatcttaacaaccatgaacatattttcatgagaaatccacagtagtgtcttttaaattgttatgttcaaaagatttttttttttaacagcaaggggggaaaagtaaggaaatgatgcttttcaccatcattgggaaaaccgcctctgtaaccatattttactcctactccctctctcacctccccttactgctccaaactctgaggctgcaagacacccaagtgggagtttggaacttccaaggcacagtctttttatctattagcaaattcatttttaaccacaaaggtctgagggcacactcttactgcattcaatacaagtcttggacattccatttctgtcatctagagcatcatatagtggcaaagccctagtcagatttatctctggtgcctttccagctttcatttctgttccactgctccacatcctagggactcaggggctcttaggtgtcttctgattctcaggagcctgtaccagacctggcctcatctgcaccacaatcccaagatcagaattactctccttttctcccacctgatcaaaactatttctggttgtctctgcttctgattttaattaattaaaattattcatgctaaagctgaaggtaacaattgctaatcaaaactaatgtcttaaatgtatttattttatgaaggtatttcctagctttgttcactgaaaaggcaaaaacagtgacaaactgaaaaaaaatgagcccccactaaggagtctctaaaaacatttctttaaaagaaccagagcccattgggaggaatgtgtgattccaactcgggcagaaaacatttaaaatcagtctggaatatcttgtcagaaagaaagctatcaatgaccactgatgatgtgttgaaaggactcgggagccaacttagaagggttcccaatgggattaaaaggaacaactgaaacagtctagagcacatcacatgtgtaaaaatgcaacgtaaggaagtgcaagaaaaccaatttgttcattttaaaactggcaaataaagggaaagaatccagcatttattccacattttctgcacggtttatgccttaagataaccaaatagttaatgtgaagggggagaataccaccattttgcaatccctaatgaaatgaatggatctaggtaataatcaccattgtctgctaaaaaaaaaagatagatgaaaggttgatggggaactttctaaaaggtgaatcagactgatagcatgtactgaacaatcttaatatgaaaagagacaaaattggcatatgcctattgatgtggcataataagacagacacaataccacctatgacattcttgctaaaagatctaatctaaatctttcaagcctcaaaaatctgtttacaaggaatagaggagtttggagaatatgttgggcaacaccatgggggtgtgataagcaaaatctaaaattgagggacactataggactaaagactggtttctttaacaaataaattattttaaaaagtaagaggggagacctatagatttaaagaaactcaggaagcatcagccatattcagtttgtgcacctattttgaataagccaactgcaaaaaaaaatgagcctatcagaaatttcatcttaataggatttgatcataatatactgataataaggaacatttaaaaattatattagtatttcagatatgattttgaaatacatactgaagtatttgtggatgaactaatataatatttgggatttgctttaaaacaatctagtaaggggtagatagtagatggagtttaggttaaacgatatttttaaaattttttaagttcagggctacatgtgcaggtttgttatataggtaaacttatgtcacagaggtttgctgtacagtttattttgtcacccaggcactaagcctagcacccattagttatcttttctgatcctctcctccctaccacccacaaccctcaggtaggccccaatgtttgttgttcccttctgtttgtccatgtgttctcattatttagctcccacttattaatgagaacatgcagtatttggttttctgttcctgtgttagtttgctaaggataatgaatgacctccagctccatcagtgttcctacagaggacatgctctcattctttttttatggccgtgtagtattccatggtgtatatgtaccacattttcttattttatttatttattttttgagacacagtctcactcttgcccaggttggagtgcactgtcatgatctaggctcactgcgaccttcggctccggggttcaagtgagcaattctcatgcctcagctacccaagtagctgggattacaggcatgcaccactgggcccagcctaaagaaaagaccacattttctttatccagtctgccattgatggacatttaggttgattcatgtctttactgttgtgaatagtgctgcagtgaacatacacattcatgtgtcttcatgatagaacatttatattcctttggagatatacccagtaatggcattgctgggtctaatggtagttctgtttttaggtctttgaggaatcgccatacttctttccacaatggttgaactaatttatactcccatcaacagcatctaagtgttcctttttctctgaaacctcaccacagcatcccttattttttgactttttaatagccattctggccaggcacggtggctcatgcctgtaatcccagcactttgggaggctgaggcagtcggatcacctgaggtcaggagttcaagaccagcctggccaacatggtaaaaccccgtctctactaaaaatacagaaattaggcgggtgtggtggcagacgcctgtaatcccagctactcggaaggctgaagcaggagaatcgcttgtacctgggaggtggaggttgcagtgagctgagaccacaccattgcactccagcctgggcaacaagagcaaaactaaatagcaaaggcttggaaccaacccaaatgcccatcagcgatagagtggataaagaaaatgtagcccatataaccatggaatactatgcagccataaaaaggatgagttcatgtcccttgcagggacatggatgaagctggaaaccatcattctcagcaaactaacacaggaacagaaaaccaaacactgcatgttctcactcttaagtgggagctaaacaatgagaacacatggacacagggagcggaacatcatgcaccagggcctgtcagggggtgggggtttaggggagggatagcactgggagaaatagctaatgtagatgacgagttgatgggtgcagcaaaccaccatagcatgtgtatacctatgtaacaaacctgcatgttctgcacatgtatcctagaacttaaataaatagataaatgaaaaagactgagaatggccgggcatggtggctcacacctgtaatcccagcactttgggaggccgaggcaggcggatcacctaaggtcaggagtttgagactagcctgaccaacatggagaaaccccgtctatactaaaaatacaaaaaaattagctgggcatggtggcaggcgcctgtattcccagctacgtgggaggctgaggcaggagaatcacttgaacctgggagacagaggttgcggtgagccgagatcgcgccactgcactccagcctgggcaccaagagcgaaactccatctcaaaacaaaaaaaaaaagactgagaatatcgttactatatagagatgttcattggggagaaagtcaatagagtcttgaatattctcgtgatgtgcagaataattgtgtagagattattttaaatcataaatacatcttatatcttaatatcttaaatatgttttgttttccatatatacttaagatatttctatgaaaatgtcttatcctaatatttgccagcaagagtcttgtgtaaccttttgaaagttgagtaataactgtaatgctgctttgcttatttttcataaaacagtgattttctttaatatatctgaaaatgcatttttcatttattttttcttattattatatgtatatatcaagtgtggcatttgagagtctgttgataaaatttacaaaagtagaattacaattttatgttaatgatgaaagaatgacttataatattcacctgattgtatctcttattttgtgtgcttttgttaaacatatgtcgatttattttgccaacatgattatatagacagagaactccttttctttcaggttggttcatgtgatcctggttaatggaacataagtgagattttatgggtgacagggagagagatcaggcttgacttgagagcacgtgggaaaagaagggggctatctcttcgcaaagatttaagtatcttataagaactgtttgccagtgcaattatgagtaagtgtatttgtgcctaatttttattttttaaaagctcaggtgattataatttcatctgtgaaatgttggaagtatagtctgattaaaatagtatatatctaaaaaaaaaaaatagccattctggctggttgtgagatggtattgcattgtggttttgatgtgcatttctctagtgatcagtgatgttactttttcttctgtatgcctgttggctgcacgtatgtcttcttttgaaaagtgtctgctcacgtcctttgcccaccttttaatgggctggtgttttttttcttgataatttgtttaagttccttatagagctggatatagacctttgtcagatgcatagtttgcaaaaattttgtctcattctataagttgtctgtttgttgatagtttcttttgctgtgcagaacctgtttagtttctgcacagtaaaagttaaatttattagatcccatttgtccatttttgcttttgttgcagttgcttttggcatcttcatcatgaaatctttgcccattcctatgtccagaatggtattgcctaggttgtcttccagggtttttatagaggttaaatggtatttattagccatatagcgatcattgttgaaaatgggtgatgagtatataggggttcgtaatgctactatctgtgctttgagtttaaatttttaaaataaactatatatattatatatatagttttaaagttatatgtagttcaaaactacatctaaaattgatttctaattaaggacttgtggcttgcaaggagcaaggctttctagagtcacttgctgaccactgcagccccctaaccagtttatcagcatcgtattggcaacttggttacctagtttatcacttttgggaggttactaatctttacttaaacagccctgatgccataatacataatattgccaccagagccattgttatgataagacacatgtgggaagtacttatttaaaatttacagctgataacatttttatgttgtaaattcctaatttcctaatcaataaaacatttatattttaaaacagcatcaagcatagcactttaaatatactatgtgtatcttacatatagtaaattcatttcctaaatgaactaccttttataaatgaaacgtaacttgcgggtatttcttattttgagaaaacatcacattttctttctttctttctttgaaacattttcctctcttttttaggaagctgttttaggttatgtgaaagagatgtttcctcatctctaaggcttaccagaagctctgatttgaagagaataaatggattttgcacaaaaccacaggaaagtcccggagctccatcccgtaagtttttattttttctatttatggagttggtagctcccaaagagtaggaaaacttggaatcaaaagaacccaaaagagaagaggttcctatatcataccctcccatgtagagagaacacattgtgttcacattgtgcatgtgcacatgaccaatatgagcacaacatgggaggcctgagggaggcccatgttcctacatcatacctcccatgttttactcatatgcaggcccatcttcctacatcacacttctcatgttttactcatacgtaggcccatgttcctacatcatacctcccatgttttactcatatgcaggcccatcttcctacgtcacacttctcatgttttactcatacgtaggcccatgttcctacagcagacctcccatgttgtattaatattggtcatgggcacatgcacagtggtttcttcattttcagcatttgtcattttcatcttcttgcctgtagggttggactggagctttctgtaggagaatggatgcaccaaagtaaatagtagtccagaaattatgttttaaagaactctaaagatgaaccaaattaagatattatgcgttaggtaaaatataagcagggccttctccttatcaccctcactggctctccctttgcactgatttttatctctattcccgacttattaatgaaatgactcagatggcatatattcccttcagagtcagcaaatctttaagtagtattcatgctctttccttccccaactgggtcttttcccgtcttcttttagttacaatactgctgttgtcttagtcatccaagtttgaggttcttcgtgactccttcctctttgtcttaaccagtctccacattctttcagtcatcctcagactgacctcatctctctttccactgcgacaactctggttcagagaatatccgctcaccatggtattacaggctcccatttggactttttgcccactctaccgtgtcccccttttctgtctccatccattgtacagataataagccttcctaaaacattagtttcttccttgtttcaaaatgtacagtagttcccaatcaagtctaaaccccttagcctgacattcaagatctggtaaaatctgattgtaccttacaaactttttcttagtctgctgaagtcagacaagctcctcaccgtttccttgggattttataatcttatttggaaaatgaagcatcctaagaaattccattcaaataaagttctaattaacttgaggtttctcagtgtttctgtttagtgactagttaaaaagcactaataccatttttctgttgttaaatttgagagttataatctcaaacacataaaatttcttgtctggtttttctcataggcacttacaacagagtgcctttacacaaacctacggattggcagaaaaagatcctcatatggtcaggtcgcttcaaaaaggaagatgaaatcccagagactgtctcgtgagtgctgaatttagtattacaagcagctttcatttctcactgatctaagggaaaagcaatgcctctgagttccaactgtttaaaacttttcaaccaaatttgaaaacatttttcacttttccaaatgttttatctttggtaagtacttggaatataaacaatgctagaaaacctgtgtcttatcattgttaagttacacagtgactggtgaagaactgtcaggtactctgaagtcaattgattatttgatttcatcccctggctacagaagtgtgacttttttaaagtttgtttttaatctaggtatataaattaagtaccattgacaatgactgtattcccccaaatccacttaagtactcaaccttaggtgtaaaagtatttaattgcaatattctggaattcaggaaagagtgcttcctgtcaccaacttccttaaacctaagggaagggatcttggctgggatcatggaactttttcagagtttgtagatgatgagtgcaggttcctccaacccagtttctcaactcagtactattgatatttggggcttgataatgctttgtggcaggggggtgtcctatttgttggaagatgtttggcagcatccccggcttctgccccctacatgcccgtagcattgcggcagtgctgacaaccagaaatgtctccagacactgccaaatgtccaaggggcacgagcggggtgggaatctcccctggttgagaaccagtgccctagcctcatgttaaagaccctgactggctggcatcttggctaaaaagagattctgagaaatagatgtcatctcctctgtgaggcatcatcctattcagggacagggacttcagacaaagctcgtggaagttccctgtcagcaagaaactattcctggatcttctggtctctggtttcaagtcatgattgaaaaagatctgagctcattcaggatttctttcccagggaaatatgtagtatttactttctgtttacaacagctttaatagagcttttctgcttctgccagtcaaattgatagcacattactttaactagaattatttcagcaggaaagccctggtttttcttagctcaagtcatgtattcttctgggaaataagagaatactggaaataacagtgacatcaggttcttgcctatgccctaattcttcctataccagcagaaaataagctggtagacacccatggccttaacagatgctgtataggctttgctatagaacaccttcctcagtctgcctaatagttggttccaagatcccctcaggcccaaaatactacctcacgaatcactctggaagggtcttttctgggcctgggcagccatttgtccttgtgctggtagttctgaacaggcactgcttaacttgcccattcctattactccctatggaatggattacttttcatgaggatcatggcacttcaaatcccataaaataccgtcaacatgggaagtcagtttgtggttagtggaatctcaggtgctcctaactgaccaatttgacagtccttagcagttgtcttgggttcctgccagcctgcaggcccagcttaagtgcctggagaaccccgtccacatgctgcctcacaggtcccagctcctacatcacattgtacatggcttcatcatcttcctccttccacctgcaacatcccagactctttgcctccttccaagcatttttaaagtactcccctccccaattttaaaagtaatatatgttaaatatctcaggggaaagaaagcacttcaatcccatcatctagagataatcacttcctatttacacatctactgagaaggccataagttaatcctgggccccataagggctccacatcccctgccttgaggttctgccagacaccgaggtaacagaatcgtgaccaccaggtgtggcaatgcatgcctatagccccggctgctcaggaggctgaggcaggaggatcgcttcagtctaagattttgagtcagcaacatggtgagaccccatctctttaaataaagtaaattaaaaatagaaccatgactcactgcctacttgcaaaatcaccaaggtagattggcctttagactcttctatattaagcctcttaggtttcacacaagaatgatgaaccaaccatcaacttttttttaaggcacatgggtctgtattcagtagataggttagaagagctgcactttggcacttgccaaagaccacaatatcaagttcactgtcactcaattttagcaaaacatttgtttaaaaagataaatattgaggagcattgcttaaaggatcttcctactattttagatattctcaaatctattctgggttcaagacagagagcaaaaagctgggtatatggagcacattggttaactttctccaatgtttgatcattctgaattgtgctttgtgttgaaacatatgaagcttattgtagtatctgttgtcgagatgttttcagacgatgactacatcacataatgtcttcttaagaacctcagggagaaatgactgtttcacttctagcatttataggctgcttggaaacctgagagccaaaattggggtccaccatagcaagtgtagattaatatgccttgcccattttttttttttggctttgttcttgacttctctttttgttttcttcttttgtacttaattgtgtgctatcctgtattttatacataaatgagttacgaaaaatgcctcatcctccccaaagtcctatgagatctctaggccctttttaaagagatctctaggtctccctatttatatttatagacactactacattttgaatttatacacagccttttatcctgagcaacttcagaaagggaaaagttaataactttctctcatgatctcattgtattactaggttggagatgcttgatgctgcaaagaacaagatgcgagtgaagatcagctatctaatgattgccctgacggtggtaggatgcatcttcatggttattgagggcaagaaggtgagaaggggtttcttctctatccagtatgtatgttctccaccaagaacctagagtaaatcagggattgacccttgtatttaccctctgagaagaggaggctactttctacattacatgagaaaagataagcaaaaaaataagacatattgggaacaagcctggaatatcatccttggggatagatagcaaatcctaactttggcgtggtgaagaaggactagattcattttgtgtaatgtaaatttaaaaagtgtttctgatgacaggtgtcataatgtaaattaagaaataggacactggcatatttaatcacccactgcatatttccagagtgctcttggtacccaagtgtatttaccctcaccataactgccttcagcatggtgagctttcttagcggggttctttatttgaagctcagccagacagggccatgtgtctaaggaccacagctcctaagcagtacataggaatacaagtccagaaatctttagcacagattataattaatagctatcactaattgaacactcactgcattccaggtacttttctagctggtatctcatctgaacctcacaaaaacactgtaagataagtattattaggacctgatttatagatgaggaaaactatagcttagaaagctttagtaacttgcccaaggccacatatctccttaatgacgagccacagtgtgaacctagacccaattcaggtaataggaaaattcctcccatttattgagtgcttattatgtaacaggcactgttaagctcacttaatcacccccataaccctaagaggtaaatagttttcccaaactcacacagctaacaagtggcaagataaaaatctagacccaagtttgcaggttaccaaacctcatactatactatcttgctattaagccatagttatttttatattcagcagctttggtcaaattcttcttttaataccatgtataattctatatatcacagcttccatgtggaaagtgatgtcttacaactactttaagatactaaaaaggtccttctatacacgcactcttaactgactttcttatcctcagtaattccagagtaaaaggaaatgtacttttggctgtcttcattcttgcagttaaatggaaatactgaccattttaggctgacctcatgggagtacgaaggggcaaatgtgctgagctgggtgaagttctcttgaaaactctgttcccaccccacttcattttttcttgtctccctctttgacctctcatgcatagttctcagattaaaaccagcagaaacatgtggacaggactgtgagcttctaggattctgagaaatttgcattgcttttgtatactcgattgtactagctgagtttaaatactccagaagcaaattattcacctggaatctcttctagcatcatccaggggtatatgctgtgtattttagagagttcttctcctgttctttaccataaaattgtaacattttagttttatggaatttctgtttccataaatactactggaatggagaacttttgaactcaatgtgatttggaagagaaaaattagccattgtatattttgctctcaccatcaacttccctttctccccccgctcccccaccccccgccacatacccaattcttttacatatgaaattacacagatagaaggaaatatcagcttagggtgctagtttcactatttggtataaaagtgttgaaactggcctgtatgtaagcttcatagaaatctgaccgtttacatggagggaaacaagggaagaggacggttgcctcccccactcaaaggttggaattgtagtacagatactcgtggaaatcatcaatggtagtatttgggtaaagtctgggattcccaaagctgaatgtttttggtaaaagagaagtgaggaactagaaggatctgagtatgcagataagttggggaaggagaaatggcagcaacagagaaaagtgaaagaagaaaaacgggatagaaatggcaatgagaaggtatttagtataaaagagaagtggggtggaatgagaagaaagtataagagaaaaggagaggataaagactgaaagaaaggggccagaagggaagaaaaaggagaggtgtggcacttcttacttatgcttgagtggatgagctgctgttcttggaagcgtacgaggaagttgaagcacatagaggaaactgccgtgctcagtgtgcaagcagcagaggactccatgcctccatgcctctgttaacctgctgtcatcagtgcaaggtaaagacaccctcccctgaccagcatacaaatcacctgttcaaatctgttttgctttaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccata

SEQ ID NO: 7 - DNA, 26864 bp, homo sapiens
gagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggtaggacgcgctcggcgccctgccgcagctgctcccgcggggacgggaggcactcggagtccgttgtatgtcgacttcccagggccgtaagcgaactttgttttttaaccaagaagtcagcctggtttgtctctactcgctgcttccccccacccctcgccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagaaaaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacgttcagaactacggaaaacttttactgaaacagcgaagcagagtataccggcatgagagggaagatgaacactcacctatgtaccactctttgacaataaatatagtatttctcaaatcagtctcaagactgatcctgtctcagaacagaccattgttctctcatttctctaatacgctgagaggaacactctgaataaaggctaagtggtgaggattggaaacgtgtgggagtgaaggggtggaggtggatgagtgcagtggggagtcacagtttgccgtacaacttccaagccaagaggccatgaatagaatatctgaaagcatcgttattaatgcacccaagtaaagtaaatcttagaagatactgctttctaaattttactttggggaaaaaaattccgcgtgagctgaactctgtaggagattgatgctaaagtgtttctttattcttcttccatcatgttggtggtggattagtcactcgtctttgactagtttgatttttgcattaaatgaccttgctgtcttctgtggtggaggtgtgtcggggaggggaagggtcagcctcagtgttgctgagatgctggtagtttctacctggaagagcagacggcttcttattgggtttttaaatgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaacactttccatttctacatgatttttattggtttcacattaatttatccttctttttcttcactcactttttatccctcagctgagctcctcattttgtgctgctttccagagcagtgatagagacccagtttaccggttcatccttcacccgtgttttcaagaaaaactaaagttttaaatttatttattattattatttttttgagatggagtcttgctctgtcgccaggctgtagcggctcactgcaatctctgcctcctgggttcaagtgattctcctgcctcagcctgctgcatagctgggaccacaggcacgccaccctgcccagctaatttttgtatttttagtagagacggggtttcaccatgttggccgggctggtctcgatctcttgacctcatgatccacccgcctcggcctcccaaagttctgggattacaggcttgagccactgtgcccggcccttaaatttatttttaagttttaattaaggaaattttcaaacatacataaacataagaggctaatataatgagctcccatcacccaatttcaacaattgccaatatgtacatttgttttagaccaattttttttagctactttaaatttcttgaggttatgcttattcatgcacttacccaaatttcatttctttttttgttctttgctagacttggaaagatcattgaataatattgccctttatctcaatgaaacaatagcaaagatattgggagtaaaacagaaagatacactggacctaaaattgaaattgtggaagaatatagaaagaaatattagatggttctgcttcctgccaagaaagttgttaatggtcagaatttgtctacctcatctttgctggagaaaaatccaagggtgttgaagaccccttgggaagtggttcctgtaatgtacagctgtatggccccccctaacttcaagcatgatcattgctttcaggctagcaaaggatttatccgctcgctactcccttttggagattttagaccatatccaagataaatattggtcataatttgctcctttttctttggctgcctagatcttgaaaatggctgttttccagagaatgtataatttttagaaccaaaagtccctctgcttcaaacagctcactgtagactcactagttagtgactctaataagaagaactaccttttattgagcagtttgtattgtctggcactgtgctatgcactttacaaatactatcttgcttaatcttcagaaacacagtcttaaacatattgagtgattaaatactgtgcccaaagtttcaaagtcagtggtaagaaacagtttaaatgggggctgggagctcaggctcagtgttaactaacttcgtggctttaggcaagttgcttggtttacaccaggtgcaaaatgaaaggaaataatgccgtaaagctgttggaggaagaagcattaaataagatgatgtttatgaaatgtttagcagaattccgagccttcatcagtgttttaagtctccagaggggaaatttgggatcctaacctagatttgtgtaactccagagactgtgttatttccttttattctctcctacttccgacctttcatttattcagcaaatgttatggagtgttcagcctgtgtgggatgctgtgcaggggtggtggtgccatgatgaacgaatttatactttcgtatactttgaattgtaggatggtctcattcacacttgactaattcttaggcttaagaaaaccctcaaacattgaagtgggtcagttgagtacatttgaagaaaaaaatagagtactgtgctgatgttttcctactgttttatttatttatttatttattgagacagagttttgctcctgttgcgcaggttggagttcaatggcgcaatcttggcccaccacaacctccgcctcctgggttcaagcgattctcctgcctcagcctcctgagtagctgggattacaggcgtgcgccaccatgcccggctaattttgtatttttagtagagacggggtttctccttgttggtcaggctgatctctaactcccgacctcaggtgattcgcctgccttggtgcctcccaaagtgctgggattacaggtgtgagccaccgcgcccggcttctactgttatttttaggaaaacatttattgatagggtttgttcgtaggattcctgaccagactagctctggaaggtggcattgtgaggactgcattgtgaacagaccaattggtcctcccctggaaacaataaggaggaatgatgaaacagcaaaacatttatgaattaaagaagatgtgttgcaaggtggtgtgtttattccttgctgttgagcaataacagttttggcccacccttctcatgtgaggtcaggaatatacattatttaatggagcttatcatggttgcaaactactttaagggaaaaatgaagcaatgtactatgaagtgatctcgcaggatccaagtgcaagaaatgcagtcagggttctcagaagcttagaggtatgaactaggaagcagaaagtccttaacatccaggacagctggtgtgttcttttctcaggagcctcatgacctccatctttgcttccctgcttttgctcttcatttcttatcctcttttcaatccagcttttgctgccttcccatgcacatggctcaagatggctgccccacaatggccacctcagcctttagttgcagatgagcagagacttcagtaacattcctggatccctgttttcatcgcctgggagaaagtctgattgtctcaccttggctcaagggatctatcagccgtagtctggcacagtgggaggcatgtggaaaccatgcatcacaaatatggttgccagggcccatgagagttatagctcttagagcacagagtttgagagctggataccataaatggtatctctgcaattagaatcttagaaatctacctgtgaataaggtattttggggaggagtgctgctgagtttgaagctctggaacactgtgaataaggtattttggggagaaggagtgctgagtttgaagctctggatcatctttctgtaaggatgtaagggattcctataaaagcttttgtattaaaaataacttagctcctgtaggaaggaaattactccacagtaataatttacagaatacagtcccagtgacagtgaaacaagtctctccaatgggcaagttttcatggggttttttgtctattttgtgaatgacatttggaaacaaaaaaggcaggagggtgtgtgtgtttaatttgtaatttcttttgctcaattttgggccactggccacttcactataaccttatctgcttcagagaagtggataataaagggatatcgatttaattcattcacagatcactcagtgctgcacactgtgggagacctgtccgtggatggggaagggaagtgcccagtgattacaaaaccacctgaagaactaagctgagagttgagtgtagtgtgcagtggttgtcaccaattctttctctttttctggttaaaaagtgcacgtttacgctcattagtcattgtttctctttgggttttctccaatttctctgttaatttaaaatgaagcaaccagaacaagtgatcaaaactatacaggatgttaataatatgggtttttagggctagagagatattagaagtcacatctatccaatgtctcagtcattcagcagttgttttcatatttggagagatgatatcttgagcagatccttgggaagggatggataaaaggtactttaatagagaaagggtggctgggtgcagtggctcacacctgtaatcccagcactttgggaggccgaggcgggcagatcacaaggtcaggagtttgagaccagcctggccaacatggtgaaaccccatctctactaaaaatacaaagtctagccgggcatggtggtttgcgcctgtagtcccaggtactcaggaggctgaggcaggagaattgcttgaacctgggaggtggaggttgcagtgagccgagattgcaccattgcactccagcctgggcaacagaccaagactccatctcaagaaaaataataataataattaaaaagaaaatagagaaggggctacgctggctgggtcagacagactgggaccagggtcagtaggttaattcagtggcatcaccattttatttgggaattttaaatataattctgactgaaaattgataaacacccttaagtggagttatgcaagcctgtctctgcataaggttttggagtatcatgaatgatttccctttctaacctttctgcttcagctcaagcaaaattggtaaaatttttcctgattcctgaatctcctggaaaaacttgtaatttcataagtaacaaacagccctccattttatgaccctatcccaagaacacaccatgtatgaaagatttctctgaggaagcttaaaggtcagggtggcgttctacccaacctctaatgagcagagtttaagcactgccagcatcttgtgtacttccggataaagcttggaaggctgctcacctgtgggccatgtttggtttggcaaggcctctgcttttgacccaactttgcagccctaggtaaattaaattacattttgatctgtgcccactgaagaccaagaagtagcttgcaggttaacattatggagaaggttattaactttttgttaattattacggcaacagactccacaattccttggtagcagcactttgtagttgttaagtgatattgctctaagaaacgggtgtcgcttttctctagtgtttgtcaaatgcacatgttctgacagtaatgatagttcagatctattttgctgggcatctgccaggggtgcccagtgggtagctgaatccagaggcactggaattgtaaatacaacagacaaatcatttgatggtgccagactaaggagttcagctttggcagattgccaggagccgttgattgggctcagattcagtgctatgtgtctgtttgccaagcaagattagttgtcttggttaattatacatagaatttgtaccccctttctctcgattatttccatcttaaaccggtatgacatttactttaattttgcatcttgttttgatattgatttgtgggtgagtttctgtccctgtttttggtgagtctgtagtgactacgttttcctgccccggtcctaacacaatcccagccttacagaccctgggtttgctggtgtataatgcaggctttcacatcttgtattggattcatttggtaccttgttacttagtgttctccgtgttcagtacagtgtcaatacctccttattaaatcaagctaatttttgattctttagaaggtacaatgattctcaagttctggagtacatgtgcctatcttatattaaacattagtttttctttacaaaatgaggccaaaatacttattgttgccatacaaaaataattccagaatacaaagaatcaaataatatgatagtaacctcaattctttgtcagtgggaagaaaacaaaatgaaaaactcaattccaggtgtcaataacatctattttttattctaatgtgagaccctgaagttccatctttttgaagttgtcaggataatttcatttgagcattgcttggaagctgtaaggatatactgtttgggacccttttatttatttttatagagatggggttctgccatgttgcccaggcctcccaaagtactgaaactacaggtgtgagccaccaggccaggccaacaaaaccccttttaaacacaaaatattgaagattcaggcaagaacatgcagtattgctagagaagggcctattgtgctttctttgtttagttttactttttaggttcactatagaacctcaagttgtcttttttttttttttaactaaactttctttcctttcttagtagaaaaatccttgaggggccctttcttagtagaaaaatccttgaggggggaagttttttaaagtaacttactgtaaccataaatcacttgccgttggttcttgttcttcctgtaatccattttatgtacttttgctagagtgtagtagtcccaattccaattctaatcatgtagtctctgtgcttaaaacaaaataatccaaaaatccaaccatgctccttcttcattatctactatacaacactgtaaagactgtaaacttagccagctttgacagccctctacatctgaccacatctgacctttctacacttaatttcccaccactgccttcctttcctcccagtccctgaaatgctagaaactaatttgccaggcataatgagcttccccattgtcttccactcatcaaaaatccatctctaccgccttctagtgcctgttccctgaagtcttcccttctgctccccagaactctgtcgtggctcaatccaggctgcccagtacatggatttattgggctgtttatgctgtccaccgtgtgcttagaaattccttgaatgcagagactgttaagctttgtatatacttttagtgcctagaacagtcccttatacttcataggtgcttgttggcttaatttcatcttcaaaaggaactttgattttgatggatatttgaatgttaaaaaaaaagctagaattttttttgggggggatagaggggaatgacgggggaagatgggtggctgcagcttagtctctaattcgatgcctaagtatttaaatattttattagagtgacatgttatgtgagaccatctcaatggaggaccttagctttgtaagttttttttttttctcagtttcgaaatcctaggtttcaccctagaaatacccgagtcacacctggatcctggcagctcatacctacaggtctggctcagagacgccagggccacgaggcttagggccccaggttctggtcctagctcagcccctggcaagtttcatggtcctccatttccacttctttatggatgagttagatacttgttttcatttttgaacttaaatttggtcagcacctaccacttgacactaggatggacacttcagattttatttcatcttcctatgatcttgggcaagtcagttctctgagcccactttcatcatctataacataggcacaataatactgtatgtctacttctaggattataaggaattaacattgagatgacatttccatttgagaaggaaaatagttgctttcagtgccttttatttgattcctggagagagcagactcgcaccgacattcaaccccagcgctgatatgacagtaatcctcagaggcagagcccagcacaaaacagcaatgctagaaagttacaattggaaagtttcctgccagcttcgggaatgacactgcaaagctgatgccagaaactgccagagtaattctcctcattactgctctacccacccactttcagctccccaaattaactagtgcagttgactaattcctctttacctttatcatttagggtgaggcattgcacaaaaactctcgactttgccatataagggctgtggttctctgtggtccctggataagaggcatcaccattatctggaaacatgcagtaaatgcagattcttcatcttctccccagacctcctgagttagaaattcacaagttctccaggtgatctcatacatgctaaagtttgagaaccattgagtaaagttaatgcattaagaagagattagatagggatggtggcgtatcttcctacagtttccctgttaacaagaaagtcagaggtcagttgatcagacattagattatttattgctaaaactaaaaaaaaaaacaaaaaacgatttttagttcacatttatagcctattatttgtaccagcatatttaattttccagaactagaattgaagcaaattttggaaccagttccctcctgttatggtgaatggaggtgaatgtctggcctttggcaagacaactgcatttgaggcctatgtggaccctgcaggggctacagagattttatggtgggcttgaggttgacctgcactgggaataaccaaagcaaagacaagatgacttggacaagtagggtcaattttcttggcctcttgcctttgttaaaattccccctttggatctttgagtttacagactgaataccaagcacactcttttaaaaaaattcttgcaattgtttgtattttgtgatttttctatcactctggaagggtgataggcaaggatgaggtaggtggagtcaaatatttcaagtagaaccaaagatcttagttccctcaaaaatgaggtgggggtgaatttgctaatgtcagacattagataaactgagttggtaaagcacgtcttaagacctcacactcttcagccagaccaactgggttcaaaaaggcaagttacctaagctctctgtgcctccatttcctcatcggtaaaatggagataatgttcctacttcatgcggttgttagggagtgtgaaggaggtccgatttgtgaagcacacagaacagtgttgggcacatagtaaatgctttacaaatgtttgtttagtaaataaatatagccactgaatttcatgagttctaatctacgctaacttgctgtgtgtcatttctttcattcagcagatctgtttttccaagtgctgaaatgcatatgtaggtttctcctgttttaagattgtttcggccgggcgcggtggctcacgcctgcaatcccagcactttgggcggccgaggcgggtggatcacgaggtcaggagatagagaccatcctggctaacaaagtgaaacccagtctctactaaaaacacaaaaaattagccgggcgtggtggcgggcgcctgtagtcccagctactcgggaggctgaggcaggagaatggcctgaacccgggaggcagagcttgcagtgagccgagatcgcgccagtgcactccagcctgggtgacagagcgagactccgtctcaaaaaagaaaaaaaaaaaaagatgattgtttcaaggcatttttcatgacattttgattggtaacttcgttttttcatatattatccattattaaagtcttgtcttaccaattattttgagttatggattctttaagtactttaggattaagttcagatgaaaatttcaaatattccattctctgatgagcctgcagtcacaagtattccttgtctctgttatgctcaaagcctttagagagccataggtgatgttttattattctgataaggctgttttctcatatcaaaggaagtcgaatattatgtttctctatagaaatacctgtgataacttctaggtccatagggtaacttctagggttaatgacttctaccaaggacttggagcggtgtgactcagggcacacactgctgctcaccttcccagtaaccaggaaattaaacaagatatgtgcaaaatgccaccgggctacatgaattctcaggaaacagcagctgttaatatttggggaaaggcatcagaaaggaaatggttaaatgcgtcttgatgtccttatccctgggctggactgacctttgctgattttataattgtgaggaagcccggttgaaaacatttctctggtgactggggtagagatgggggagggggatggttcccagtgtccgttcccagctcaggctgcctggcggtgtgctcgggtgtgggctggctgccaccctcacgcagcgcacgtagccctgtcactcagccatcaccctgctggcttagagccagtcctccacgggaagggcggcctgcccaaacccaaacaccctgtattaatatggcgatgttgccgggcctgtttactgtgcctaattgcatgggctctggctgaatcccctccaaggagaagaattaaccacaatgcagaaaggaatgacaatagtctcttaaattcctggcctctgagcctttcagtggcttcttgggggagggcgattcactcagaaggtcgtgcatgaaatgcgggatctcctggaatagaatcttgatcccgcacagttcaactttagaggcctttgaaccccctagaatttcgtgcagacttctgtgtgtgcgtgcatatttcttacatccttttaatgtaagaatctcaaagggctattgtgcctggtagaactatcatcactgacccaggagaactagatggatgcttccacgctctgggtagttaatgatcctgaagctaggaccaagttcatctgaggacaggttttaaagtgagaatggtaaattctctgctattcaggcacggtgctctcacctggccaggagggtgtgggcagacccacttcactagagcaaccgagagtcggttattacttcttattttttattttcagaagttctgaagtttctacaatattagaaaattcaggtgtaggtatgtgatgaccgttgttctaccttgggagagaggtcatgtgtagcagtgttctgggtaagtaggttctgcgagaggaattatttttagtgtggatttaggacaaatgaggagggcagaagtagtctgcattgtggaagtagagtagtaaaaaacattttcatgaataatttggggtttattgaaaggattacctacctgacaggtatttgtctggtattctgaatcttccaaatggtctggtgagatgctgaagctttggaaaggtgaacacggtggctggacacagcttgtgttatggcccaccaaaagtgtattttctctttccccctcattttattacatcagtctgtaactagaggcactagaagtcaggaaatagaatagctaggcttgctcttaaccaacaacaaagatgaccagcaagatgccaaggtaactgatgacagtttacacaaaatttcttacttttctaagagctcacgtttgcttacaactattttcttcatgcccgtctaggtgaagtttgaatgtctaaaaattctaaagcacttttaatacttacaagttagcactgcttcatcatcacattgagaccttttttgttcaattctgtataaaggataagaccagctggcagcaaatgtgaacttttgcagtgacattttcttaaaacttggagaaagctttgcatagttgccatcgtcttgtaaagaggccctgtgaacattgttctgtaggaatttaatttacttgacaacagtagatcccacaaaatgtccttgaagatcacatatccctgaacaagggagatgatagaaggttgaagtagtaattccagtttgcttttcatgtcctccggatttaagttgcaaatgattttttgagttcttttctctcactccttgtcagagccaagtggaaaataatggaattggacattttggcttaatttgtctttagatttttttttttttaaataaaacttgtaaagggcatgtctctttcaggttttgtttttttttttctccagcctttcctccagtatgcctgcatatagcagtttgaatacctaaacgtttttttggtttttctttctttttaaataggagaatttcagatctagagctgctgctagcacatatagtgcctttgttccagctactaatcccctttcccctccctcagatgaattaccaaatggggcccctacatcagcagggtgccttgatgaaggcaggacctaaagtatgtgatcatggggatgccctgctcactggccacagtcaaggcgtgtgttaaaatatgtgctgaacataaaccacctagaaaaatagccctggaagtgtagccttcagctcctctacccacagctgactaaaaacattggcaagtttgtcacctaggctgttgtcacccgaatataaatgagacccatttctggccagaaaacttcagctatcacagtctacattgtgatgagttgcttggctgtttttccaagcaaaagaaggtgcatggtctcatgtatttcctcccaactcttatttatttatttatattttttgagacagcatctcgctctgtcgcccaggctggagtgcagtggtgcgatctcggctcactgcaacctccacttcccaggttcaagcaattctcctcctcagcctcctgagtagctgggattacaggcgtgcgccaccatgcccaactaatttttgtatttttagtagagacagggtttcaccatgttggttaggctggtcttgaactcctgacattgtgatccacccacctcggcctcccaaagtgctgggattacaggcgtgagccaccgcgcccagcccccaactctttacacatctagttgtctgtgttgttgtgcctgtgtcgttgtgccttatggtggagaagggaaggatcctgggcctctgttgctctgtactgggtggacatgggggaaggacttgatggagcgaggtgtcaggatgcaattggaatgtggatggcattcaggatgaggcattgtctttggataggatgtgtttgagtctggtggagagagatggggaaggtgcccactcagcagctgtctcaaagtagctttacttcttggaagtcctcacacagtgatctcaaaatatagcctgatatatgtgtgtgtatatatatatatgtgtgtgtgtgtgtgtgtgtgtgtgtgtgtgtgtatttatttatagccctgattaaaaaattgggatcaacaatattcaggagagtttacataaagatctgattgcctgctactctcataaaatctgaagatttgctctcattgaaaataacagcaagtcccctcagtgtaggtggcataacacacaccagagttctgactcatgtataccggattggcttcaatcatttgttactcgcaaacatcgaaagctattttagtttgccagtcctgggttcaaaactacaaaacacttaagtagaattgggtctctgaagaagagacgttctacagcttcagttgaggggaagacaaacataacacatcatctttaaaaatagctaacatttattaagcacttagtgtgtgccaggccgtgcattaagcattttacatggattatctccctgagtctgcataaacccattttacagatgaagaaaccaaggtgtaaatgagctaaatgcagattatcccgtacttaggttgcattttattcaaagtacgctttgctcaagaccatgcttaattcaaaatgaatccttacaaaggttggctggtatttctacttagcagctggaggggatctagcatttgtcggtagatcagaatactagtttaaagctccttcaaccagatagttttgaaatcacgcttttctcaacaaatcttaaacaatggattttcatttattggaaattttgcaaataaaatgagatctaattagtactttaatttggtgagttaaattttgtataaaatgccactttattataacttgttcaagatcgagtcatactagtgaatctgtctcaaatcatgagcaatgtaaaatacatttctatgaaaatacatgttgcaactgttagcagagaagtggtaacggcagggtgggtgtatccccttctcacctgtgggtctgaaaaatgatcatcattgcctagtggatggtggaggtcactgatgccaagtttttgaaatggtttttacatgcagtcaagctgcggttgatggcattcaagagcattctgtttaggcattggaatggaaatcctggacttttatttttcaactttacctttggacttgatgagataggttttttttttttttttatgaagtcagctcactggtaactcttaacagaaccactgtttccttttccacctgtggcatttggggaccacttttttatactgggttttgactgttacggttctatatatctgtgtatatcttcaaaggatacatatacgtttgttgtctggacatggctgcatacgtgtctagagcacatattctggtctagagccagcctgggccggcctgattcacctctccactcatttcctattgctacagagctaaggagaggcctctgggaatggggatggtgggaggtggggtgggtacactatataatgtcagtggacagagcggtaaatgtgtaaggggacatgtggatttatcagtatatccaagaatagaactataggactatactgtatgtgctgctgtagatgacactactgtgttaaacttgcgtaaacttcaaatattaatctagtcaggaagttttagaaaataaaaagcctgtactaaagtaggcatcctcttgatatgtgtcagtttattgcttggcatgtttgttatatgatcattaaattactctggcccgttcttttaacaataaagcattgaagacttctcttctgttaaacactaaatcccttccccggcttgatgaggtttagatagcaactcagttggactgatctgtttccggagtttgttactgccccgtgcacaaattggcacagaagtgaatggctagttattgaagtcaggcttgcttctcggtgcatccttagcctcatggttttagaccctgtcaaagacgagcaaatagttgggaatgtgcccaagcaaagacccatctcctatggcactcatccagaaaacacactgataaaattggccaaatgtagcctcaactggcccactgatgctcgaaatgatttccttccattgtttccaacttgatgcatgtggtttctggaaccaggagagagggtgaatgttcactctggccagaaaaattatctctttgcctccctcttaagcagtcggatactttgctgacatgtaggggttttgtcctaatagtaagtcctctggaattggctttgtctctgtgtgttttatagatgcggcatttggtagaggatttacttttgtgagtttgtatccatcttttttttttttttcaatattttaatctgagctgagttctgaggcagagaaacactccttaatgacctgaagaactatgttgctttttcaagggttgatgcttagatcaagtcttagatcttcttgggcctttgacagctgcgtaacccaatcccctctttataggaaagagacagcctgggatcacagttagttgcagagtgaactatggcaggcatccagaccactgaccttttccttagagaagagctgtttaagcatataagattatagcattgatgtcatactttttcttttcagacacactcagtggggggagcctgagataatagggaatccagcctgtaattgtttgtggcttaagcgactttcattattggctctgtggtggctcttataatcctaatagctgcttccaggggtgggtaattctttagtcattataggtgactttatttgtctcttcttctcttgctaggcccatcaattctgtttgctaccaatcacccttcctcaagccatgctttgcttagtggtaccatcatttgttaaatcttcattgctgacgtcgcctcacagtttcaccttctgaaagatgttcaagctaacagcctaacttgagctctaaggatgacatcacattgacattttgatgttcaaaggcaggatatggggattgtttgctgcatgaggatatgaagtttgagagagatggtgatttaagctttaaaattgttgtaaagtccagttactattcagccttattattgatctggcatgcaaggtgtgttttgcctagttccgtgttttcatgctactattgagagtgactcggcagccacgttgaagctgattcattgaaccactagcccattagcttggggctctactcaaacggtcattttaccaatgaagcaacgctgccatttatcaggaaatatatggcctggatctttacatgtatgtttgaagataggtcttttaaaatgacagaaatagctattgatctaggtaaaatgtgaacttactctttagagaaagagccattcgctagttcattgatttatttatcacattttagatggacaccttctgtatgtcaggcactgtcctaggtgctaagaatacatcagtgagtagaacaggaaaaaaaatccctgtcctcatcttgtgttgctggttctaatattttccttgcacctactgcatccctataaaaaatatttttcaaacatggcggtatcctgtgaagaaaagaactggctttctatactttgctttcttccccctccccactctgtgttataatttttcccttggaacaattagaggtctgtttactctaatggtaattttcagtaggatttttggtacggttttctactttattcttccacctggttgatacaggtagcacttagacaaagagaacttcagattatcacctgattacataattatcaggaagaagacacatattaagatacatgcatggcttttttcctgaaaggaatctccctgtgttgtctgtgttaacaagttagggtgcggcttcctattgatcttcctctattctttctatcctgagcattttattgagtaagcctgaccttttcctcctttggtgattagttctgtcactttgtgtatgcaaatacctttagccattgttctgaaacagtgtgagtgattcagcagcacttgctaaacagtcataatccctaaactccacacctagtgactctgattttgtagcatgggaaactagaaactgcttttccaaaaaggagtattgaagaaaggcagggcatacaaacaggttatgcaaacagggcatgcagataggttactttaagaaagactgtgtaaaatgttctagaactgtgggaatattgttgaactactttccactgggcagagccatagtatgacctggccattgtgcacagaagagtccaaatttatgtaccatacatgaaattaagaagccagcaactacctgtaaatgtcacgtaacacccaaggagactgtgttacttatctgctcaccagtgggaggagaagattgtctgtctcagctttgttaaccagctttcttgggatttctccataggcaatggtggcttgctatccgggaaatggaacaggttatgttcgccacgtggacaaccccaacggtgatggtcgctgcatcacctgcatctactatctgaacaagaattgggatgccaaggtacttttgaataatgggagtagagtgtggggttagaaactacaggaaaatgattcagataacttagaggagagtttatattgagttcatagttgccgtatctcccactgatgaaacatttctatttccatttcataacctcctgcgacaatggaattagtcctaaagttgttaagaagaaaacaatgaagttaatttggagtggggtaggtagggtgattattaaccctacctctgggaagggtggttgatgaagggaaggtaatttgatattaggattaaggattaatttttttcagtttaattcagagttgttctgactcaatgcagaataggatatacacttttccctcccagcagcagcattgagaaagttccacaaaaatagaactgtaggctataaaaccatccccaagagagatttcccacacagtcctctccctcggggtggtatgtctcattgatggctgcttgccatggcttactatggtttgtgaatgccaaaggctttgtggcttatttttgtattatagaacttatagatagatggagatatgaagcctggttccatgcttacagacattcatctggactctgtatgctttccgaaagttaagaatgatttaggagtctgggaagtcagataacttttcaagcttatttggcttttgaaccttctgcatctcaatttcctgttcattaggcaaatactggctgtcataaagcaataatatttatccagagtcagaaaaacgaaacttgggaaaccattgaatcagtgaaaaggcctatctcttctccctgtttggtaacatgactggaatacatccattaagtctcctttaaaatcttgagaggtgctgatagagacaagagaataaagttatcagactggtaataataaattgcaaggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactctattttacgtccatgggctttatgactgtggggggtgggagtgctttttttggtttaaggtgaataaggagatatctctagctaagtttgatataaaatttggtacgaagtggctgggcgtggtggctcatgcctataatcccagcacttcaggaggccctagtgggcggatcacctgaggtcgggagttcgagaccagcctgaccaacatggggaaaccccgtctctactaaaaatacaaaattaactgggcatggtggtgcatgcctctaatcccagctactcgggaggctgaggcaagagaatcacttgaaccagggaggtggaagtggcagtgaaacgagatcgtgccattgcactccagcctgggcaacaagagtgaaactccatctcaaattggtacaaactatgaggttgaagtaaaaatctggggtaccatgcatttggagtggtggttagcagatggcatgtttctaaatggagctgaaatatggttgttgataaactacatgagaggtaagaaataatcccccttctttgtgtctttcagctacatggtgggatcctgcggatatttccagaggggaaatcattcatagcagatgtggagcccatttttgacagactcctgttcttctggtcagatcgtaggaacccacacgaagtgcagccctcttacgcaaccaggtaatagccggagccatgattcctcttccggagcttggtgtacaaaccctagttccagagaactctttaaacgtgtgtcctgtgcatgtgggggattgaccacaccccatagctgatagcaaacttgtttggagtctacaaaaattaaaggggaaactttgcgttctttagcatatcaaacctaacctcagtttgaaagtactattaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagagaaagagtaatttgttttgactttctctttttgtcttttccttggtttgaaattggcttgggcttgctgtatccatggtccaacagttggatgttttattaatcttttctttatcatgtgcacatgaagattctcagagtaactgaacaccttagtattgtttaggaccaatctagacaatcttgacaaaaaatcttcattctcaattctgcctctcatttacctttgtctgtgtctaaagcaataagccgggcagcattggagggctatggagtgcagcttatactgagactagcattcaggggcaggaggagagaattttggtaggatgatgattaaaccctaacaagcctaattaaattaagatcacatgtgccctcctccggaagtcacacagcttagccccaaacccagttatatattaactgccaaatcggaatgtcttctagatgagcagggaacgaattctaccactgaagtcagcttttgtgttttatggggtatgtaactaaaccctgttgtttgtggcagaagtctttggttattccccaatctcatgatgactggccttacagggaaaacattagcaaatgttgatgagaagtcccttgaaaaaaactcaagtgctatagaaattgttagctacggaagtagctaacaatcattacaaaatgaaactttaaaaaaaaaccaagcatgaaatggctcccattacagtctatccaatgaatgggataaagcaaattagtggggatgcagtagaaagctctggggcattattattattcaattgcaattttgcctcaatgtccaaaactaaagaaagcaagccaagagttttaaacatactgtgatttacataagtcgtttttcaaagcttcactcaaatgtcatctcttctctatgttctcgccaccaacttgggtctcccagtctttagcagaatgactcccttctagtcctttctgtagaggctatgtttacctgttgcattattgcaaaatcacctgtctcccctacttggagcctgagatcgcagaggaagatctgatcacagggtcatttgaattcctaatgcccaagataatttctggcacatacctggaattccttatgcattttattacattgaaatagaattaaaaccagagaagttaattttaaattaaaatcagcgtagacaggccgggcatggtggctcacacctgcaatcccagcactttgggaggccgaggtgggcaggtcaagagatcgagaccatcctggccaacatggtgaaaccccatctctactaaaaatttaaaaattagctgggtgtggtagcgtgcacctgtagtcccagctacttgggaagctgaggcaggagaatcgcttgaacctgggaagtggaggttgcagtgagccgagatcacgcctctgcctggcaacagagcaagactccatctcaaaaaataaataaataaataaataaataaataaataaataaatcagggtagacttctaataatagagaaaactttaaaacttttaatgtgagatttataggacatttgtgtttctagtagtaccattaaatctctttccttatatctgcttatctttcacagatatgctatgactgtctggtactttgatgctgaagaaagggcagaagccaaaaagaaattcaggaatttaactagtatgtgtttgataattttctgtgacttttgatcaagttaatccttgacttttattcaattttatgtagttttaaacatgttctgttcaatctgttacggcttagctttatatataatgacatcttgatgggttttatcctgaaaccttggccttagggctcttagaaaaatcagaaacaatgcaaggggcttcccctgagaatgcccactgaatgtatgatggtttatgatagatgggaaatagttaactttttcctattaatgttaaccagtcaaatgtaacattaaattttgcccatgatttttggcatattgcaaaggaaatataatggaacccagttatgatggcaaaatttattatattgggtgagactgtgactctcagtataacagcagggctcatgtaatataaactgaatataacagcactactcctatcccttccaaccagtattagaaggcagcatttcccaaaatacgttgcattaaaacacaaatcctgccaatttggtaaattcctggtcccaaaaatgtgggaaatgttgcatgctgtatgcctgtcttaaaaagagtcacattgctcactagcatattaaattaaggcgctaagagatcctgcagtaaggaaacatatataatattgcctagcccataacccatttggactgtatacctctcaaataccaaagtggtctccaaattgcacccaggaaatctcagtttgttttctcttccagatggcctacactgcttaactctgatatgtgagtgaggctacacttcatacaacttatgctcagcattagcccaagaggtgccaatgctggatgtaaacccaaagttcctccacagtctgtgaggcatatgggaaagatcccattgcaaagtcaagagagaatcctttggcagagctctattaggaggcttatataagatgggaagtgtttactggaggctttttggtgacatttgtgacataaaactcatcagagctgactccataccctctttattctcctttctgtccccaacccagggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattctaa

SEQ ID NO: 8 - DNA, 3056 bp, homo sapiens
attagaggctccagccccgccgacttgcagacgtgagatcgggcacacctgagcggcggcggggcggtcgtggccacatccggggcgacgtgcctgagtcaccccgtcccgccagcgtctgccagtccagccagtccgcccagtctctcgcgtccgagactcgcctccagcctcccacctccgcccgggccgcgcgagcctcgcgggggcgggggcggggcgccaaggggcggggctgtctcttaaagggccccgggccgctgcccttaggccacttcctgggggcggagaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctcctcctgtgccctcttcgcccccctcctttgggggccccgtgaccctgaatgtggggggcacactatattccaccactttggagaccctgacccgcttcccagactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccggcactgaggatgctgttctcagtttgactgtggggaggagagagaatggggtactagcacccctgaagcctctttccagctctgcttcaggagctatgagagtcgggactctcctgcacctgactggagctcagatgtgggcaggaattcccaaacctgagcccaccaaggactcacaagtggtccagaaggtctcaacctgtgctgaccctgggaggggtagggaaggttctctcagcttgttcttgcctaaggctgagcacctccagtctctccttgatttggagctcagtgtttaagggcttggaaaaggggggaacatctctttacccagactagacctagcaaaaccctggaaggatattgaggtctggggaaaagggaggactttgcattttcccaatgcggtctcttggaccatggcttctactcctgaagctgggtggcctggcctggcctgaccaatgagaggccagaacactctggaacatcggaagaggagttctttgctatgttccaagccatctactgagggaggcagaaaggccacaacccaccctaggttgatgtatgggagctaggacagtccccatggcaatggggctggagcatccctcatctggaagaatcccatactgatggcagggctggccagggggaagagggtagtatctgtgggtcctggcctttcttcatgtgtgcgtgcatatcagcccgtgtggctgactgatgtataggtccctggcatcctggttcatatctgtgttgctgactacagtgtctgtgatgtccgcatgtccaggcctgtttggggttgcctagcgactcttctggcacagggtgtgtctgtggtatacctgtgaggtggttgacaattagtagtttaatcacagggtgtgtgtgtgtgtgtgtgtgtgtgtgtttatgtgcacgcatgtatatgcatcaccacgtagccaggaggggcctgttggggtttgagtcactgggatcttcctggtgagaggtaagagaagtcactgggcttagctgggcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaaccacaaa

SEQ ID NO: 9 - DNA, 15166 bp, homo sapiens
attacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtaagtacccccaagtccgctggaagcacccgtgcacctggtccccagctatgtggcttctcgacgtggctgcctgggcgcggcgggccccggtcctcgcagatccgatccctcccccacgcgcctgcagtggcagccctggaatccagtgcaaaccgcgcgtctggcccctcctgcttccttttcacattgctttgcagtcccgggcgtccccagttctcttgctgtcctccgctccactctgcagtcccggtgggcgaagggtgaggagtaagggacctagaggggtagggagttggagcggggggcgccgggttgtttcactgctgcgcccgtcgcctgctgacgtttaggtctcccagacctggtggccgacccctactacatccaggcgtccacgtacgtgcagaagatgtccatgtacaacctgagatgcgcggcggaggaaaactgtctggccaggtacgggctgatatgtctgaggccccgctccccggtctaccttcagggggcgctctggtgcctggttctgactgctactgcttcgcgcagacaagtgttaggaagtgggacaagagctgggaagtgggacgtgacctcctgggcatgctgacctggacggagagttaatatttttgaagatttctgtgggttctgtctcaaagtgcagcaggaatcacagaggtggaggaaacccttatcctggagactgaaagtctcatgctctttttccaagatacttaaacttgggagtcaattgttccaatcacttttcataaaacaactatacagtaattcaaaaaatttattgtaatggaagggtgtgttaatacccccttaaaagattcggggcaaatttgccatcgtagcctcattggtaaagactaagttttcctcttttgtttgagaccacgatgaacttggttgttttggtattacttcagccagaataagaccgtgagcaagagctttgtttttccactattctaaaataaaatagtaactctgggattggggttctctgggtttactgctgggaaacagcagagggagcaaaagatgttttaataaaaatttaaagtgtaaaataaggtcatcaataccacctgaacatatagacacactaaatatattagtaggaacacagtgatgtttatttgtacatttcttccactttgaccctttataattgtcaggctaaaggaagtgaagaaatccaagctcattttcattcctgagtcttgcatcactcacaccattgaactccctatgatgtttttacagtactgccattgttttgggatagtgaagttacaaaattattaatttaaatctgggtatgctcttttagagttatttcctcagtttgcagctcattaacttttttaaaagttttgttaagtttgaagtttgtaataaacatctatgaattattttttttattgggggattatttccacttcagtttcactcattcatatgatcaaacttgaattgattctaaagtttacttctgacatttagatttttaatgcttattatgtttttactgttaagatctgtggatttccataggtgttattcattcacttattcaccaaatattcattgagctctgactactccaagacggttctaggagctttggattcagcaatgaacaaaaagaaacaaaatgccttagactcttggaactgatagtctagttgggaaaggaggattgtcactactatataatggatgttttatttgtagttttgtctttagttaatattccatgaatataataatttttcttttttcaaaatcacagtacagcatacagggcagatgtcagagattatgatcacagggtgctgctcagatttccccaaagagtgaaaaaccaagggacatcagatttcttacccagccgaccaagatattcctgggaatggcacagttgtcatcagtaagtaaatgggcctcctgggtacttttgggttgcttttcatttctcaggtgatttttgatatcacaaatgcaagtcttatttcttacctgaagggagaaaattgctattacttatatttagaatttttctctatgtaatttcacataacccatctactacaagatcctgttatcttttgaaatggaaaatctgaagcccagcttattaaagctgttgataggatacagcaattgacttcaataaaatttactccaatgcattacagataggatttctttaaaagtccattacagccaagatcatctaaagttagttagcattaaatagcatttcataaagaccacacgttttttatcacaagcattcagaaaccattctcaaagaaagatgtagatgatacatcccatcagctcagaaggaccttcttccatcttttaaaagacctgtatcaagcccaaggtggttgccttttctatcctaaatttaaggatttttgcataaggtaattctatcatttgccttagtaacttgcctgggtgtttattttcaggaaatcctcatgtgtggccttaaacttacttcctgaaatccaagccagtcctcattgttttttccttatgtgggaagatgaacagctcagcaccttccatttaatgaaataacaaaagtagatataagtcccttaatttcctgataaaataggaatattttatttctaaataaaagtgtgtactatttaaataataatggtggataaaacatgccatgagttctcccttgcttttcactaatgattttaaatatgtgagaactcaattttttaaaatctcatagaaaccttgaaaaagtcatgtgctgcttttcggaatgaaacatcagcagtggcagccaaggggaatacactagagaacacagggcaagtttcacttaagcacagataatttattgtccatttctatttaatattcaaagacaaaatggggtacaataagaaagcaaaatactgaactaagtcttttgtcctagtagcaaagttaaaccttacaattttgatagacttatgtcctggggaaaaaaaaaccctagcatgaatctctcttttagaagataaatttggtctcaattttaatgtgaaaacaaatttgtgaagccatgggggaagtcatttaatatcttcattgctttctctgtatgtaactgaccaccatctttttgttttgtgggacatcagacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacaggtatgttggcaccctgaaatccagaacctcaagcctcagagagaaacgggtcatctaccgttagttagcattaaatagcatttcatgaagagcacacacatttttatcaaaaggatacagagactgttctcaaagaaaactgtagatgatataccccatgagtctagtattttctttcctctcacctctcttttataaagcattcaatttgaggtccatgttgttaagatgtaaaataattgggaaaaggcaaatgatggcttgatgatccaaattacttttgaagtatttccagttatgcatgtggcccctattcatgatcacaggtcagtgtgggtccttgttacagtccacaatgaagaacaaaaatttactctctgaaaaagtctgaatggttgacaacatatgcacccattctgtattccttaaccggcttagtaaataactgtaaaaaaagatatctctgttttttcacctgtgaaaccattccttccttctgttttatgctgaaaatagaatagtggttgcggttagcaaatggaggaaaaataagtttctttaaaagcactttaaaaagttgcctcttttaataatgcaaataagagcagaaggacaccatttctttctccacacatatatatttaaatctacagtataattgatgtcagatgttgtttggatggatttttttaaagtagtgctgaactaagcagtttgcatgttttatcattggaaaatgcgtgtcagttaaaatctatgtcagtatttccatatgaaaccctaatttgtaaaaggacattataatttgactcccgcccagatcttggcaaggggtagtgaatgtacataactgagggtatgaagggatcagcagttggcatcttgggaagcaaattccagggctgtggcaggaagctgtttggtgacctaaatgttaccattgcttttttctctgagcttagaacatcatagcaattggagggggaaaggttaacttctacatgccccaggacagtacttacttaagaaagaggagatgtaacttacccacacattattcatgtgtgcatatacagattcccttttcagtgatctgcaagtcctgtgcaagggacctagagtttatttgccccatttacaaaaagaggcactctggacagctcactctgaaatatttgaagctgggattgtagacattatagcacttctggttcccccccttctttggggtgaccccatttcattttatatggtagctttcttgttaatcatcttccatatatgttctttttaaccattattcaccaaatcttgcattgagcgatttatatatttgtttttttcattagatcaatgtctctttcacatggacttcatttaaaggaaaaaatagtctctcaatcacctaatgatgactcagattagtttattgtaatgctgcttaaatgtattcaagcataaaactaggtataacttctttagatttatacttttacatattaataactcttgtgttctgagacaaaaatttacatattaaatatatacgaaactaaaacagttgaattcaccttattaatttaatgtaacaaatagtatgtattgctaaaactcaaattgctgatttagagagcctcagctaacattcaacattgaatctgtttttatattttgactttgcctacatgaaatgcctatttgccttagtaactcgtttttgcttgcttgtgcaaataatcaaagcttatacttaagttctgccagcttatgaactcgagtgccaatttcagcatttttaaggctcttttgtctatttgaaggcaagataagcactgaagcattatgtaaacccatcttaaatgaatatctaatccagtgaatcctttacaatgtcatgaacattgtggtagtagtagaagtaataactagcacttattgagtatgtattatatgccagaatcagaattgtatgctggaatcagaccaaaaattcttcattttatatttactactcaacatactgttaagtgatgtatggatcaaggtaggaatctagataataacaacagaatatgagtctcactgctgtgacactgacccttctgagttgggcctgtctgtgctattgtgtgctctatgacagcacaattctcccctgctcttcccaaatcaagctacagctaaaccagcattggtagagcatgctaaggtgattttactgtctcttgggtgaccaaagtgatcttaaacagcaaagcaatattggttgctagaattgaatggcagtattgagttaaaatgaatctagcatgtactttgaatttaaattactattagaataaaaatacaagttaaaactttttgtgaagaactaatggaatcaagaatatacctacagactccaatctgaggaaacttctctagactataacattcttaaaagcaaggattgtatttgttatatttttctcctcccagcctgtagaaggcattcatttacttattgatgtgaatattttagcaagtggagtgatgtggcattcatcaatttagtcatgcatttaccccttcaacaaaatatgtcatatttcagtgactgtatgagagagagtatagtggggtagttaagaacagggactctggaccttgattacctaaactcaaaaccagcttagccacttactaggctggatacccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactctacccttagggaacttgcagcctctggttagctatattcttacatagcatgttataatgcagagcaaaaagggataaacactgtaaaagctatccacaataaaaagtatcatggacgttcaaagcacaagaaggtaatttccaaaaggggaaactggggaggatttcactgagaagaggacatttgagctaagataattattatgtggcctttattcctgaactgttaaaattctagaactttggtagaggcctattttgttccttcagattgcatttatctctggtgatatatgacacttttaagaagtgaggtgtactactacttatattagtcctgtatcttttttagctggaggtgctataaggctgagtaataaatacttctcaagggagatgaaatataagtatagttttatgtcagactcttgtaagtactaacttaaaatttaatttgcaaataatagcatattatttatcatagtctgaccacataccataattttaaattttttattttgtttatcttagggattgagtcctggctgttatgatacctatggtgcagacatagactgccagtggattgatattacagatgtaaaacctggaaactatatcctaaaggtaaagacctttgaaaatatatcatatattgatattgcagatcaataggccctcttctctggattcaaatgttaaataatcatggtattggaagcaattatacatcctcaaactatttataaacaatctaatctaatctaatctgtcttattttaaagaacttcaggggaaaatatgcagtctctttccataacgtctccagagtttaaccacttacttaagttaaaatcccttccctgcttgatttagctaagtcctcattaacaatttccttattgtagccctatggaaaaagaaatactgaggaactctttgtgttgcccaggtcagtgtaaaccccagctacctggttcctgaatctgactataccaacaatgttgtgcgctgtgacattcgctacacaggacatcatgcgtatgcctcaggctgcacaatttcaccgtaagtgttatttgcttagctaagtaattgttgtcacaaataatttttgttcatgccaaacattatacatagaatgtatctgtttctgctactacagcagctttcttgtaagcagaccaaaggcagaaaatggtatgcagtctgattttatttttttaaataatggaaggcaaaggagaatgtactaaggtttttagttttcaggagaagcttagttttcaggagaagacataaacagaccacagtgtttacccagaaggcatttgtgaaggcccaatatatcaaattgctcaatatgtagagtgggtgagcttgtagaagccccagtagttgcttcttggccccttcctcgcagtccctgaaagaattgctagggttcttcaaagtacattttgaaaaccactgccataaagtaagcaactgaagagttcagccccctctggtctgtacaaatcaagatgtcatatatttgagttctagaaccattgatactaggaaaatactctgcaaaagattgaggtgtgtggaggtttcttcataatattcctactcctgagactcttcttagaatgaaatactggaagatatctattcacagggaggtgctctgatgaaaataatgaaaaaaggttgggtaggtttgactgcatgcctgtctgtcctgccccatctccttaagcactacctccccaagtgttgctgggtgctagattataattacatatgccacttgagttatgccttcccaacaatgagaatactatttccattggaatgatactcaacactcatcagctttgctttgtcactggagaaccaccagtgccactggatcatacagacaggtatagcagagctatactagaatctcataattaatagaaatttctgcctgatacaaaaacccaggactttctacataaagaagcagagactgtgctttacaagtgttgtcacaacattagagatagatgaagcctgtgatagcaaaaggatagcactgaaaaaacagagtcacatacattcttctgaacatgcccacagcacagaaaacctggcaggttttatggcccatattgtgtggagttggttatagtagaaccaacccccgacccccaccgccagaacaccattataatttaagctaaaataatttgcacttaaataaacagattagttttttcttaatttttataattccttaatttattcatccattctccatttatttattcatttgcactctcatttttgtactgtttgttgatgccctgagctagatattactgaataatgcaaacataaataggactactaatctctatactgctgtagccttattacactattttcagttaattacttatgaatttctttgtttaatgtctgtctcctgctctactcagtgatggctgtgatttagtctcttgtccactgttgtatacccattgtcaggtacaggtctgccaccttgcagcctctcactcactgcttaatgaatttctttctcaaataatttgagtaaaggcattttgagtaggggaagtgagagaattacacatataactgtaatagagatacaatatgagaagtttcatgagggataaaataaaatgtggtgagatcagaaggacctttgctataagtttggtaactcccaactatgtcttactgacttcccactagaaataggtctggagaggtctgttgcatagaatgtctcttgcttttaatcagtagaatccattgaattgggtattgctagatatttagaagaaataaaaattgttgtattgctccagcaatatgactgtacaagagggattcctgatgtggtcactcatatagagttgaatttttttttttttttttttttttactagttattactgactgtaacaaacttcaagagtggttgaagctggaatgtttataactaatataaaccagatgaaaatatgaaaagtgaaattataattagtgatcataataaaatgtcatacttattctgagtggaaatattggggaaagtatagaatatttgagaaaaaaaccccacaccttcaggatagtaatacttgcttcttacattttgactttcacatcaggccttccttcctaggaatcagagttcagacagaggagaggtctctttgggctgagtttcaggagtgactttaggatacatttgaattgagccttgaagtctggggaatgcaccggggagcattaaggaaaggaagcccagggcaagtcaacgtcacaggcaacttgcatggcaggaggaaactgcagggcatgtttggaaaaacaagtcttctagtttggctaaagcatgaattttgtggagttacgagttggacaaaaaggatggaaaagtaagttgagccagatggaagacagccctgaagagcaggctaaaatttattctggaggcagtgggaggctgaagctttttgagcaggaagtgtaacttgcctaaggccatcaggtcagtctggtggctgtgtaagcagcagtgagtgtgactctgaagacatatcatgtatcagttcactgattgcttttcctgccagatatttaagagcattctgttgatgtgtaaaagccacccagtaaatagttgaataggtatgtgctgttaatgtaccctctctccttcattttcctcactgaaacaaaatgtacggaccaggtgactctgaggcttctttcagttataagatactatgtaagtttttttttttctcctcacagaatttactgtttggaaattggtagtttatgatttgaataagtgaattttcacttccttacatgaagatctatggtcacatttaaagacagtaatatttgattgattagctttggtccagtttctgcctattaatgtattattctacatccaaagccatgctggagaaggactaattcaagatggagcagaggccttgactctacttcttggtggacatgccacccttgttccatggaatgaattcccctggtcagggatgctggtcccagaagtcctgctgtactcttgagtgtttcagaagtggtttctttgcctctaaatgtgaagagtgtaggcatcaggcatctctgctgttgacatagtcactttcttcaaaccattattaaaatgatgtactactgcataatttcacaacatgattgctgcttaggtggagggaaactgttgcataaagtttttaaaaggttgactttaaatttgtctgttgtactcattcattatattatcaggttaataatttgtcttattttgtcttcttaatctaggtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatagtcacacttataaacattcccaatattcggattctagaagaaatgcaattcattaaaattttcctggcactgagagttaatctttagcagattgcatgaaaatactgaattcctggtaaggagatattttgttttaaaaataatgtgttttgatacgaatcagtgtattaactgataactaaaaagtactcttttttctatatatacatatttttttgaactcatattcacaatcaacatattcaatcagtgagttaagtctcattcctagctaccaaaattcctgggccacttttaaacactaaacatttcatttatcctctaagctaaaatggtgctgagttatttaaatctgaatgtaaaatgcattaaatcttagcttgtggtatataaacatttaattaatataaaactgcttgctataaactaagtaacatgtcatttggtgttaggtttttagtgaagttttagcttctcccaaatttttcaggaatgttatttgtaagacgtgtaacttttttgaagaactcttattttaaatgctcagacattggctttatgttcctctttgcattctcatattcttttattatacatctatactatgattgcaagattatataaaaatgccttgaataaatgatttcaagtgtc

SEQ ID NO: 10 - DNA, 60134 bp, homo sapiens
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggtgagtgtgtgtgtgtgtgtgtgtgtgtgtgtgtgtgtgtgtctgtgtctgggaacggagagattgcgcgcgagtgtgtagatgaggggttggtagaggtgagtggcgctggcaaggaggctggagaggggggcgtgggtgtgtctggcttgcagactgggtcgggaacgggtgtggatccgagaggctggtggcgcttcagtcccgtagcacacacagggcggtgtgcatgtgtgagtgtaagcgtgtgtgtggggggagggtccagggtgtgtcacagtgcaacacgcgagccggagcaagtgtctgcgagcgccactgggcagggtgcgcccccggaggaacccgggattggcgcatcggcggcgtgggagaagtgacctgggcgagaggggtctcgcggacatttggcggccccttgagctggctggagctaggagtggcgtcattttcgcctccgcccaccctcccccgctttcctcccctcccctgcctctggtgctggccgctcctgccctccacgggggaaaacagctggaattacttcgacgttcctgggggatccgccgcggtctctgattcagcctcgggaggagatttcgggctgggcttggggaatgcggctggttctgggggaaacacgctgtcacgcctctgtcaaattagtagctggagctgggatttagtgggtcggttccttacccacccctcccccatatcccccgcctgttgtccctgctgtccctgggggtcctgaacagcacgcctctgtggcttggaagtgggagatgcctggcagtgggtgggggaggcagggcccttggttatcttatgcccatccaagaacaccccttcctcacggacgctgggggcacttcagtttgtttggtttctttaagctactgggaaatatctaatattcagaagtcagccagtggccaggcaggagggcggtagacatccttataatacccatcagctgcacgggaccttctcctaagctgcctcaaaagaacatatctaaatacaaaccccctgttcttgctgcagaaatgtagtttcaaggcgaatttttcagtctagactcttcctgttgagaaattctggcgttcttattgagtttcacaaatgtgattgaaataagcaaggtacagagggggcaaaccccagcgcctttcttggaagggctgccttctggtggggaagacacacggctggagacgcagaccggttctgtgtggtgtgtgtggcggcagagccagccccaggctggggtggcacagtgtcggggatgaaggaaggtgtaagggagagagagggttttggtgtggatggaaaactgggtgttcccctgacctgtgacttcttagctttgtgggaccgtgtctcccactgcatctgggcaaggaggaggatttgcctgccctgccctgtaacctggcccctggcccagcgcctggcaggtgggaggagttgaaatatgcacatgggatgaagtggatggctctgggtcttctgccccattctcctgtgaaccagcaggttgagtttcgggcgaggtaatagactgtgcatgggtggaggtgttggcttttgcttttgagggatcctggagtgtctgtttgggtctcttgtgaggaagttcttttggagcaacaaagtttgatcatttggaatggaataaaaaactcacacaggacctacctagtccaacttctttccattttacagatggaaaatgaggcacagggatggggagggatgtgcccaggccgaactgagctggagctcagctttgtgagaggctcctgggtgggactgaaggcagtggaaagggttcctggcaggattttgcctgcctgctatggaggggcgaaaggaaattgcatcttcattgaatttctggtgaggaaacttttgaggccaaaggggcagagcggaatgattttttttaagtgtaaatcaggtgttcttgagagattagcaaagccagcctgaagggcaggggcttagaggctgcagccccctgagttggcctttgactgaatggggctgccccccccccatgacagaagacagatctcaactgagctgagggcccccctgggttacgttgaaatccgctggcctgaacttgcctcctcatggacctgaaagaaagatagcattgtgtttttcgggtggcccaaagctgcagttcttccttgggacccaaccccagagaatcccattccagatgtgactcagaggccttgtcctgggagagaaagcgtgatgactcagcatctgagactcaagcagggttcaggtttgactcagcctggaaggaaggccagggagggacacgacatctctctccctccagagcagccactgtctccctccatctgccttcatcctcgcaagaacgttgcctggatcgtattgctccattgaatggatgaggcaactgaggccaggagagtttcaggatttgcctgttgccatatggctcaggtgggagagccagactttgaacccggacagttggacttcagagcctttgttttttttccatgacaacatgttggggcgcctgaagaaatcaggctcaaatgaaaaggcagtcaggagctccatgcctcagtttgcttttctgtaaaatgagagtaacagacatgatgccatcagaatgtgtaaatattaatctgtgtaacctgagaacagcactgagcatgtggaaaacagcgtgtaggtgtttgccgtcagtagcacccgcagaagacattctcaaggcatcttcttggcaggcagagtctgggaccctttgtcctaaacctacccaaggctgtgaaagtgcctgcaaatgcttgacctaggtattgctttttgctaagcttatgtaggttgcataatagtgtcatgaaaatcttgtctgaaatgcacatttccaggcccggtctcctgcgattctctctccatcaggggatatgctgttgtttcaaagctcctttggctgggttgggaatggggtatcctgcaggcagacagagttgagaacctctgctctggaatgacaggggagagaagaaggaaggtgtagtcatacatgccgctgtaccttcaggccaccctgtgtccacagtgccagggaattagtgagtgctcagtaaatagctcttgtttgctatagtgccttggaggttcaatgcatcacatcagctaactgaggtagaagacattctttccacctctcaggtcagaaaattgaggctcaggctggtgactcttctgtccagagtccagtgagtggggttctgcccaaggtgagcctcctgagccctttccaccctccaacattgcgcttggaggccacccacaccctctgggcccaccttttgagaaggagcttgtttcctggatccaccccaggctgttgttcctgcctcccttgatggctgtgtgatggaagtaccgcgtgtccacttgctttttatctttcaacttggagatagaggcaggctagatagcggtcttggctgagaacttagcccaggcaggtaggcagaagggctggggacactgaggccccacaggaaggcggctgcagaggtagagggccatgagtaggtgccaacctggagccgtgttctcggggtgggggccatgtgaaaagaaacctgggctccctcgggtggggcgtaagccccagcactacagaatgggaatggattacacaatcggggccataagcaggtctctttgacccagatctttgactttcccacctaacattgtttgcagacctgcctatgccctacctgcctgggctccatctctgaccttttgagtccagcgggttttcttgcaactgagctggtagaaagtgaggctccttaacagtctgggggccttgagtgccctccccagcagtttaatctttcctttctttaaatctgtggggagactttctgcagctatacattttaaatctgcatagagttctgtttgaagagaggtgggtgggggcccaggtctccaccttgttctcctgccttcaccctctgccccacccccacggaacctaagaagattccaagtaaccctcttcaaatatggatgtgagagggccatttaagaggtgggtctatggcctctctcagctgggaatgcttaccatctctccttcctcctttttaatcatggaactctcctcctttctccagaaaggcctccttggctgtcctctgctggaggggaggctgggttgggtccttcctgggacctgtccatgtctcccatgaaacctgagagcctgtccttagtaggtgttgtgttagtggtggtggaaaggacatctccactgattaaggaagtaacttggaccatcttgcatagacaagatcggaggcccattccggagggtggaaactgcaagaccattctggggaaggatcctgttagcgtggctagcatcccatctcgggacaaagggttctgtatgaggaagccatttcctcgtcctctgctaacactggctccgtttgtgtgatttccacaaattatctcagaccatccagcgcagctcatgcctgtcttgcaatttcacaaaataatcctctaaggagaccagtgtcctcctttggacttccagttattcacctcgtcccctcagacggtcgtcttctgtctgccaaacaaattactcgtgctgccaaaactccactgagaatctccaggaagatctcggttgtattgcagaaaagaggtgggccctgacgagattcctgacacctccctcttcctgctgttgtgtttgggacactcttgctgacctccctggtgctgtgctcaagttgaacacacagcagttcagtttcagctccagcccctctggacccacacccagggagtgaatgcggctttggcttgtttgagagggagacagtggggttcaccttcttagtgatccctttttcattccttgaatatcaaacatcactgatgcctcctgggtttcaggctccactgcaaagtacaggggccctcgaggagttcctactgtggttttgttctctgacatttgtactgtttccttgattctgattgctctgatacagttccctaacctctaaactagggaactttcttgaaggtccagtgaatccacccatattgtttgctgagttgattagttaagaaagacagttcgtgaagactgccaacttcctcaccctccccagggccttgagtttcagaagggccagaaaacaccaagagagcccatgaactgctttgtagcttgacttcaaaatctctttgggcaaagaaatgacaaaggattgtatccacagtaaggcagggctatccagggcctatctcaaggtggttttccttgaggttcaggcagaaatggtgctgttctcggcaattttctggggaagttgctacagcaaacagccacagcacatgttgattttttccctccttttaaaaatctgttctataaagagcacaatgtgctggagagaacactggctttcatgtggccttaaaaccaggcatgttacagagggtggaatctgggccagttgctgttggtgacaatcgatgctacccttgtcagcaattcccgcctgctctccctttatctgcttcactgaaggcctccaggggactgttgtccgccctcccccgagggaatgagtgccacacctgcacccacaacaaaccagtgagtttttcacctttccctcagtagggaggaatctagacatgtggcctttggaagtcaagtgggcctttgtgtttgtttttgagcctcaggttacccatttgtgaactgggtataatacccagcctctcccggggcaacctccttgaggagcaagtgaaacagtgtgctgagtgaatgcttttccaaagcattgagttggccgtcttaggaaggtactatgggggagctgaaaacagagaaccttctgggtgttgtgaagggagaaaagttcaagatgctggttttgccaaaagctcaagcctgctcatgatggctcagtggtgactgcagggtggaggagaggcatgtgactgtcccagctgacctccacacgctgaaagcctcatggtcacgtgcagcccaccttacaacgttgtatctgggccacgggtggtggtgaggactgtggatatatttagggcaatgtgagatcattgtcaacattccctttaaggttgctttaaccttaaagcagccagcttgatgcttgctgacttggggcacacatcttaacctcttgatgcctcagtttccccgtctgttaaatggtgacatgctggcacctccctcctagggtttctgtgaggcttaaaggaagtaccgggtttagagtccagttagtgccacagatactgttcctggtgctgtttttgtggtgtgtctgtgtagggttacattgttgccttcctgtggctgctcttcctggtgggcggaacctggaacttctagaacagatcatggatgtttctctgctggataccccttcagcctcaccctgtgggagttgtggcggggcccaggagagtttgctcaagagggtgtgcaggtgggtggcagagctggagcaaggcactagtcttaacagacaggagtctgaggctggcagaagtgggggccttggtccaaggtgcggggctaatctggccagagctgagcctggcagggccttggtaagaccctgtggcccttttgtcttggtgaagcaccttcctgcctgggtttccatttgcctgtaagtttgttgtggacagcgtgatctccatagacgtacactgtgcctactttacagatggagaaaccaaggcccagagaggaagtgacttgctcagagtcatggaataggaaagtggcagggtccccatgccctgattcctaggccagcgttcctgctgccccactgaggtttttgggaatcacaggctctgtgtgtccccctcagtcccccaggggctgttgaacagttctcaagtggtgtcggattactgaagatgcctctgcccactgccctcccaggtcccagggtcacgggtcacgttcttttcttcctcgggcagatcctggccttggctttgcctggcacctgtgatccagctctcctctgactctcctgggtctgctggactggaagggtatttgtgtagcccctcttgggccctcattactcattgacagacagtgctggtggagagaagggccccagtggtgacgcactgggcctgataatcagaaaccttggtggcatttgctgagcattttccatgtgtccctctcctcgctgggactctaggactgaaacccaggccacatcctcacagatgtcctggcatctccaaggcaaccctgaaaggaaagtatgttgatgaattaagcaactgtttgcttaattctccatgccattcttgaatttaagccccactgctgatcattgggagcaggagttagcatgcccattgacagacaagcaaactgaggcaaagaggttagatagccaggcatggtggcatatgcctgtaatctcagctactcaggaggccggagtaggaggatcacttgaacccaggagtttgagaccagtctgggcaacatagcaagaccctgtctctctaaaaaacaagatgaataatacatttttaaaaagagattcgataaattatgcaggatcacagagctaataaatggtgacaccatggcctgcaagccttcccccagctcctggctacctttcgcttctctggcattggtcttctcggaattcctcccaggcaggtggatgggaaaagaagtgaagatacaggctggcagctggtgctgtgacctggagccctgtttttggtgctaagctgggttttagctgaaggagacctgctggaggggtttcttctgtgcttcttggggagcaaagatggccttggagatggagacacggtttgtcagtcccaagccactccaaaggtggggctggtgggctaggagtcagccctggttcccccgccatgctgtgtgtggccctgccttgccaccccacctgctggaggacctctttgatgctttctagtgggtcccaacattctgtgattaggactttgcatgaggcagagggagggcaggagctggagtccagcaaggacctcaagcccagggacaggctccacctgccacacttgctaagccgtgagggcctcaggtgcccgggaggagggagcaggagtggaagcaccagctcgagccgccaaaccaggtcacgtatcacctgccatttcctgctggcagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggtgagctcaggacagctggcagccgcttgggcccagccccctcctccgtgaatgaaggtggtggggagtgcacgtgtgcgtgtgagtgcgtgtgagtataaatgactgtggatgtgagagtccatgaaagtgagaatgtatcagtgtgtaagaaagtgtgagtatgtgagaatgagtgtgtttgtgagaatgtatgtatgtgtgagtataagtgtgtgaatgtgagaatgtctgagtgtgagaatgaaagtttgcaagtgtgtcagtgtgagggaatgtgtgagtgcatttgagagtgtgtgtgtgtgtgtgtgcgtgtgtgcacgcatgcactagattaaataagaatgcatccaactgacattttctggatactgttacctactaggaattactaaaatcagctattccagaggagggtggatgtcgcaccaggggacatttggcaacgtttgcagattcttttgctggtcgcagcgtggggtgtatgctgtgggcatgtggtgggcagaggccagggatgctgctgagcctcctcccgtgctcagggcagcccctaaggcagaggctgcttgtggggcccaaatgtcagcagtgctgagctgaggatctctgtccaggaggcacagacgctgtcctggatgctgtccagacagcatctgctctgccctccagggggacagacagacagtggacacagcccagatgcagcctgatgagtgagcccaagggagtgcctgtcccctcgggactgtgagctccgtgggggcaggaactgggtctgtttgctcatgatccccagatgagtcccatagccagtctcatcaccatagctggtgttatttttgttctgagctctgtgttgggcacatagaacctagtgggtagaaacctctgaataaatcctgagttttccatcctgcttccgtgaactcagatgttctttgagggccagcctggtggcgtgggggctgggagtgggcagattgtagggagccaagtcctggggtggagtggggttcaggcccctttccctggcttgagccgaagcaccttggctttttaaattttaaaatttttattttttaacatttttatatgttgaacttccttacatgatttcctttggataaaagctcctgcaaaaaaagtttgaaaagttttttggttgaggcatcagggacaaggtaagggctgcttgatgggcccaactcgggagaactgaggtgagggagccgctctcctcccaccctacaggctggccagatggtggaccgccagcagctggctgggtcaacctgcagagagcaccttctgcagtccttggttcatgcggccttagtattgcaggacgcgaccaacatgcaggctaccccgaggcctgcagcccccacagtccccccagactagtgcaaagctttatccagtctcccggcagacttcagagtctaggacacttcctaaatggttcaaaatcaatggaatcatttgggggacaataaataatgtcactagacattgccaaatgtcccctgggagagaaaatcccccctagtttagatataccccgtgatcatcctcagcagttttatctctggacttcccaaaggcctttagcagtgagggggctgggtcagagaaggccccaccagctcccaaaagcagatgctcaagaacttgatatttctaggacacacagcgatttttttaacccattgcctcatgtggtctgggaagctaagctgtaggaataaaaaaggtgccgggtagggtaaagaggtttcaccagatagaggaaacggggaaggtggacatttctgtcttttctgttctggagaacgagagagctggtggagactgacagacactatgtcctaatgtgatcacggtttctggaagccaaagagaactgaccaaactgggctgaaccacagcatttctcgagtccttttaaatgtagaatttgttttccagacattgcactcttggggtttagcaatgatttaaaagtgaattttactgaaagcatgctgttgagctacattgctcatttattcagagagggagttgcagcctgactttctgcctaggagagtctctcgtgctgggagctagaggtagagaaaagaacaagctacctgcttgatgaagctcacagataggactgcttgaacccacctggtgggacagtgagagccccctgacttcaccctggcgcgctttgctgagcagggtatgctaagaagctcctgtgaaatgagaagtcctttcactcccagaatgaggggtggcgttggcagggccctgggtttctggaaggctccctaggccatgtaggcgaggtgtcccacaggccagggtcttgggaccacgaacctgctgaattagcaaggctaacagacgcgggcctttcatgcctcctgcctccaagctggcagctgcccaggaatgctcacaaatataaaaccgactttgttttcagaatgttctggagcatagactccaaagtctgtataaagccattcttgtggggctggttatctactggggaaaatcatgctggggccccagaccagagcaccccagtggagagcaggatctgcccacggaatgccatgtgttggcacaagggatggacccggggtggattcggggtggcccgcacttgccggctgacctctaagaggtgtttcaccaggttcttgggagttcctgggtcttcagaggagccctaggcaggaatttcagaggcttgcattctctcgaccattgcatccgaggggccttgggcagtgcggggcccaggttcccactctgaagctggctgtgtgagggctttggtcaggcgttttccattcagaaagtctggatctgtgaactgggtgggtggcctgggctcttccctcttgtcacttacttcttctccgccggtcctctgctgctgtctgtaagacttgaccttattctgcattttttatgcttcaccccagggattgatgggcatttagtttttctaacttgactactgatctagaagaatacatgcttatacttctggtttctagattcagctcttggaggcatgcttaatagatagcaccacctgcccaagccttgcaccccagggagtcagtggcagcattccaagtcttcctgggctgtgcttcagtctggttttgcagcccacacttctgcacctgccctgtgttagagcacaggtaacccctctggtccatcccctgctttgatccaggaagtgctttctgccttggaggtcttttttcttacaaaattgtactgtgcgttcaaatgcctgccaaactccttgacttaaggttttcctctgcccctcttcccttttagcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggtaagcatcgtgtgagcttgtgttcccctttcattgtcacacgggggctgcctgactttgggatcagcaatgcaggtccccttctagaatgcagtgagctgcatcctgggtatggtgggtgggcctgaacttggtatggggacctgtttgtgaggctgatctatccatttcattgggagggtggtgtctgtgagcctcagtatcctctcccaggaaatccactgcgctggccccaatgggaagactgggttgggtccatgggctgtgtgtacaagggacctcctcatcccctgcagtgcatcacgagggaggtgaagctgctgggcagagcgcaggcctggccttcttgccattggtcttggatttgcttcctttaggaaacctctcagcaggaagtgttgaccttttggcctttgtctccttgcaggcaggtgacagcagggacatgtctcgggagatgcaggatgtagacctcgctgaggtgaagcctttggtggagaaaggggaggtgagtggagatcttcctggctaccccatcacaggcacatgtgcacatagacacacacaggcacaccggagctcacacttgtacttatgggcatgcaaacactgcacaaatacacatgtatacagcatacacacggcatacaaacatgctgcacacacatgtacatagcatacagacacacatgcgtacacacataacacatttgtccactgcttccttgaaatgcaaagttgtgagaggctctggttcaagtcccataggatcgagggctgggccccttgcccacttctctgggcctttctgctctcatttgtaaagtgaagacatcgaaccagaggttctctcagctttcccgtctctaacattctgtggttatagaacatgcaacatggggcccagttgcccatagggactgcctgcctcagctctcattaaagccacatactctggggccgcactgtctgggcttaaatcccagctgtgacactttgcagcttggtgtccacttgctaacctctcagtatcttcatattctagttcttcatctgtaaaatggtgacattaggacttacctcatggggccaagtgaggatggagtgacctaattcatagggaacagttagaactttgccatagaggagatgggcaatgcatagtcactttttcacttgctattattatctttttgggcaaacctcttctgtcaacagagctcttcctgttggaaacagaagcccctgtctataggctgggctggcagggcccagcctgggctgattgttctgaagatgaatgaacctttacatttgcacagttgacaccgtagcttcaaagcatgtttacatcccaattctcacttagcctcataactgcctctgatatgtctttttaaaaatgtggaagctttggtccaaaagtgaagttagtctaaagccaactaaatgcttttaaaagtgataattaccatgcactaaccacatcctgcatgcctgcttctccgccgaccgtatttcaactttggttcatgcaggtcccaggttctgtgatcgtactcattttgtagaggaggaagttgggtcttagggaggttaatttgtcttctttgcatagttacaaagtgtgggacatggaatcaaacccaggccagcggacgttggtgaatagactgttcatttaatttccttatgactctacatgtggctgctctgttttaggttcataatttcatagacttttctttacaaatgtgtgaggcaaccatctcttttccccttttgcagatttaaaaataaaaacaaactggtcctagacaggaaggggattggtcaagttcatccagatagctggtacaactagagttagaaaccaagcctggggaggctacagatgcttgcttatcattccacactaaggtctgcaaaccttttctgcaaagggtcaaatagtaaatatcttaggcattgaaggccacatgacctctgttgcaactgctcaactttgccattatagcaagaaagcaaccatagacagtatacaagtgaatgtacttaatgtgttccaacaaaaatttaaaatgtggtgaggcggattgcagtgtgccaacccctactgtatactatgcaatttctaaatctgtgtcctctaaactctgggtctgtgacatagtcttctgaaatagtcaaacagaaacttctagatagaacaaatacatatcaccatattcttatttctcccttttaaaaaaccctgtgaaaatagtatcccacactttgctttattcacttgacatttctgggagatcttttcaacatcagtccataatccacttgcttttctctttttaggtacatagtattccactacatgtatttgcccagtgcccagtatatgaacacatgtgtctttccagccttttgctattacagacagcactgcaagaaatttgcacccttgtatctttcatgtgtgtcattacatacatgtgcaggtacagccctagaaaaaagttctcagaagtggcatcgctgggtccaagggtaaatgcatttaaaacaacattttttatttatttcgggcagcctactggaatccttagaacattttatgtatgaaacacatgtctaagagcttgcccattcagggttacatgccagtgcatctctcagtgaatatttaccctttctttcaaggtttagacggaaataaatttctttcaattccttagattgactcagcaaagtatttagagttaggcttgactattgggaagttcttccttgtgtctgtcctcaatctagattgccactatactctgatgacgttttgaaggttggtgtttgctgtacagaatggctttccccattctttcccaccagtacacactcacatgcacatatacacacacagggcaatggtataggtgccagccacgtttgtttccacttgaatttacccaaagtccctgatgttcttgcccacagctcaggggatgtggggctatttgaatccccagcacgagggcctgtgttgtcatctagtcttccaatccctgccatctaatgggagctccattccatcatcctgttcccctcatcgcttctgcatttcgctctgctgagccgtcttgttttctgggggtttgtggtgggtgaggctggggctcagttttcacagtgttgggactccatctctgggtcagtaggaaaacatgccagcaacatctcttagaaatgttggccagccaagactccagttggtcctccgagtcacactttcaccaggccagaggggacacaagacttttctctgtcttcctgggcctgtcctgccatggacagctctggtaaaagatagaatttgggctgaaactcagattttttttttttttttttgagacggagtttcactcttgttgcccaggctggagtgccatggtgtgatctaggctcactgcaacctctgtctcctgggttcaaggaattctcctgccttagcctcccgagtagctgggattacaggcatgcgccatcatgcctggctaattttgtatttttagtagagacggggtttctccatgctggtcaagctggtcttgaactcctgacctcaggtgatcccgcctgcctcagcctcccaaagtgctgagattacaggcgtgagccacagcacccagcctgaaactcagaatttttagattgagggaaatgcttagaggtctccactgcctcttctactcacaagagactgaaatttaatccaggtccagatgacagcagccatggaaaaaatgtaaggaggaccatgatgtggtcaggtttgagttttaaaagtatagcacatgggtggagccggggagaccagttaatagtcagatatcacatttctgtatctctcaagcttgtgatcagcttagaccttcagctttttatctatcaaggctattgtcagaaaggagtccagttaatgtgtctgcttttctgctggacttctattttgagatgaaaaggaaagtctcggctgggcacagtggctcacacctgtaatccccagcactttgggaggccgaggcaggtggatcatgaggtcaggaaatcgagaccatcctggctaacatggtgaaatcccgtctctactaaaaatacaaaaaataaaaataaaaataactgggcgtggtggcgggcacctgtagtcccagctactcaggaggctgaggcaggagaatggcgtgaccctgggaggcggagcttgcagtgagctgcgatcacaccactgtactctaacctgggcgacagagcaagactccgtctcaaaaaaaaaaaaaaaagagaaaaggaaagcctgcctttgtgaggaattaaggagaccccacaaaggaggaagtgtaggtacagattcaggtcatagaaaggcccatatgtcccaatattatttctcttacagagaaaacagatgaaattgacaattttttttgtcttttcacagaccatcaccggcctcctgcaagagtttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccaaagaatcaggaaccagtcacttcccacgaaagcaggacagagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcacctcagctgtgtccaagaataggctctcaggagaacgggctgggctctctcagccgagggctgggtcagaacttcaggaaatctaagtcctggactcgttagccccaagctggggtgggtcccatgctgtgctggcctctggagggtggggcagaaagcctgagcatatggcgagcttgtggtctccttgaaggaggagaggcgcactcctggaccagccagagagccagaggtggctgaggtgttctcacctgaaccgctacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatcttgcactgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagctgagaccacgtcgttgcactccagcctgggcaacaagagtgaaactctgtctcaaaaaaaaaaaaaaaaaaaagaagaagagagacagcactgggaagtgacttgcctggggtcactcagcagtgattggggaagtggtgccagactctgggcctcacctcttccagccctgagtgctccccttgctgcttgtgtaggttttaatgatgttggtgagggcttcttacctgccaggtgctgtgctgagagcttgccagccaatatctcatgtaatgcctcaatatctcatgataacaggagaggcaccattagctttatttttcagatgggtatactgaggccagagtggagggactgggagccacacctagctctgcctgaccaggaaggaagcccatgttcttcccgcaccactcatgtgctgaggtccaggcttctcccatgccctggccagagctccatcccgttcctctctatgttgcaggacgctgggcatgcgaaggtgctccaggagggtgggaggtgaatgtactatcttgaggtttatcaagtccaagccttcattttacagctggggaacctgagggacagagaaagggggaagtcactcattgagggtggcatggtggggcagctaagagttatggtagcaatcctctttttcaccctcctgagaatgggaaaaaatgcacccagggaagtcagagctgcaatagatgcagtggctgtggcaccagcaccatggccttggttatttgactggttctctgagctgagaacagctggaagttagccccaggggtcatctgctcattcagggatgggccgggccaccccagcctccctcagcctgatcgaagctgcccttgccaaccttccctgtggctgaaatgtcagctccttgtgttccccaggggagcggcttgctggcactgaggttgtatcttcctgcagtggggatgtgattgtccatcctcctcaggtgaaggccccattccagagccaggaagagtgaagcgcaagccccatgggtgccctttcctggtgattgacccttagcacaagatgcttcacctctgtttccccacctgtgaaatggagacagtgctccaggcttgttaagtggtggtggagagaggacactgacaagggccaatgatgtggtgcttcccgcatcagtgccgggccaaacatcacacaccctatccactaactatcatggagtgttttcccgaattatttttgctgttgtggaaacatacacgtaacatccaatttaccaacttaactacttttaaatgtacagttccgtcatattaagtacattcatattcctgtgcaaccatcactatcgtccattttcagaactgtatttatttatttttatttctgtttagacagagtcttgctctgtcatccaggctggagtgtagtggtgcgatcttggctcactgcaacctttctttacctcctgggttcaagcaattctcatgccccagcctcctgagtggctgggattacaggtgcccgccaccacaccgggctaatttttgtatttttagtagagatgggtttttccatgttggccagtctggtctcgaactcctgacttcaagtgatctacctgcctcagcctcccaaagtgctggaattacaggcttgagccactgtacccctggaactttaaaacctgcagaactgaaactctgtcccattaaacaactcctcattctagctttaggcagtcatccttctattttctgtctctgtgattttgattactctagattttgattcctctaagtacctcatacaagtgcagtcatacactatattattattataaaactgtattaatttgcattgatttgttctttgccagtgtctggctggtataagttagcatcgtgtcctcagggttcatccctgttgtagcaggtgtcagcatttccttcctttttaaggctgaatcatattctgttgtatgtatgccccacattttgcttatccatttgtccgttggtggacactttgggcactttgggctattgtgaatactgctgctgtgaacatgtgtacagatatctctttgagatcctgctttcagttttgggggacatatacccagaagtggaattgctagaggtatcagtccattctcaagctgctataaggacatatcagaaactgggtaatttataaagaaaaagaggtttaatggactcacagtttcacatggctggggaggcctcacattcatggcagaaggtgaaggaggaaccaaggcacgccttacatggcggcaggcaagagtgtgtgtgtgcaggggaactgccgtttataaaaccatgagatctcttgctctttataaaaccatgagatctcttgagactcattcactatcacgagaacagcacaggcaaaacctgaccccatgattcaattacctcccactggttccctcccacgacacgtggggattatgggagctacaattcaagatgagatttgggtggggacacagccaaaccctatcactggatcatatggttattttggattttaaaatcttggttaccaattctgagaaacctagaaagcatagtttatctgctccctgcgaagataattcctcacatttttgtttctctggaaagtctgcaaaacacttttacattctcccatctcaggacacaggcaactgacctactcccagggaaggtcaacctatgtggctcaggctggggtcggctaaggcgctgccccttaggacatcattaaagtgggggccacacagagaagcctttggaaggatagagcagaggtcaggataagatttcccagcattgtgcaccagcctgggctgagccgtctgagttaattccccaagctgtcctatgaggtcggagcattttccctattgtgccttcctttatttctttaacaaatgcccactttgtgcctggcattagtttaggtgctggggatgcagtgatgagcatgacaggcagtgacctgtgttttcaggaacctaaattctggaataatagctcagcactgccgagcacagaatgtgtctggcagcatgccaaatgtgccccacgtgtgcttacggcgatcctgtccccatcctacggagagagaggacctgaagcacagagaggttagggaacttgcctgagatcgcagagctggaaaggggacctcaagccatttgcttccagggcacatatttgaaaccaatcccgattcctcagaagaaagagtcaaacaaacatacaaacaagcaaatgtgagcattccagcttctgtaggtgctttgaagataacagtgaagggtgatatggagccaggtgatgggatagggcatggctggggtgctgtcttaggttgaggcttttttttaagtggtgacattgcactgaagtctaaaagatagatagagccagtcacgtgacaaagagactggggatagatcattccaggcagaggtaacagcacaagcaaaggcctttctgatctgaattctgaaatttccaagggcaaaaatgtgttattcctgtaagctgttaacaggctcagtgttcccagtaagtcacaatatttgagctgaaatctgagtgttgaatgacacttttcaaggttgttaccaaaagaaaatctttgtctaaaactgtattcatttagatttggcttcttagattggaaggtgttagggactcaagagattgatgaaagcgtcccccagattttcagcagtctccaaaatcttgggtgtagggttgctgtagaatttccttcagaagatgcagtgcagtgtgacgacggaagctctctggggcctgatgggttccagggccaggaactgagaaggacagagctttggtcaagggggcctacagggcgtatcagcccggggactggtcagcataatctgacctcagattcacatgggagttgcagcaaagcgacaggacagcacctgtctgccatgcacttcagtgtcctctgatgagccaggccagcactgagggcctcccacgccctcttgctgaatctttggggacctgtaccatcatccttcctttacagataaggaaactgaggctttcccaggggcggcagctgtgaagtgagccacattgagcccagggctgtctgacgtagacagttctctcaaccgtgatgcttgagtatagccctgttcctggaaaggctgatcaagcccttatggactagattgtggttcacctttgacacgtctgcttgtcaaaaaatctagccaagcagataatctaagcaacacttcattgggcttatgttcagcctactgacaatgagttgttgtaggactcaagagttgctgtgccttaatggcaaatgaattttatctattcatttagttggtttcttacctgcttgttaaaatagggctccctcctgggcagttcttgccctgggcatagcttccctcctggtccagtctaaggagtctgagtcgctttattttgtgtatctgaaagcagccgatgtcattccttgaaaaataattactgcttcagcactttgactaactcaggcagattcctacttcctttaccaatgtagtcaataatttaggcttttattgtttttgttttttaaatgaatcaaaacacacacactgagcccagagctcggcactgaggagctgctggcggagtctgcattgagctgctgggtggcctgtctctggagacagctcgcctgccagagcagatggcatcaggccttatctctccatcactggcatcgcctttaggcggtctctttgttttgtcctgggtgatgttcgggcaaagtgattggtgatttgcatatgaggttctgccagcgctgtcaggcccccacctggctctggttcctgaaaagattccagaaccctcagggcacggggtgggcgggctgctggcctaggtgtccgggttgcaggaaggacacggtctgatctggctcggctgagaggcctccagcatcaggttttaggcaattgtgtttgcagatttgatgagtagggagggggggagtattttgggttccagcttattttctttggctagaattctagagtccaagacttctgctccagttggagagctttgtggaaggccacctgggggagggaagaggaggaagaatgaatatttgcatactcattgtctcagggcttccctgctaaggtgaggggtgttggcctcttttgcagatgagagacccatttgaagatgttagggaacttgccaaagggtactgtagagatagtcctagacttagatccatctgcttccgaaaaatgttatagtcatggaagtcgtaatggctggcctctcttgagctctgctgtacgtcagaaaccgtgctgggctattttcctgcatccgctcatgtgatcctcatgaaaccttgttgagggaggtatccttgccatctatccttgccatccttgttttatgttgaagatacgaggcccagaaaatctggagggatttgcccagtgtcacgccatggtgagatagatggtgaaagctgattcaatccacacgtctggagccaaagttcatttaacgagttttggggaagggacagcagagttgacttcatcaccgataaattgtacctcgtgggccgagtgactttctgtggcttcaaattgctttttctgttggatttgctgcttctaattccctccacctggatcttgagttattcagatggttagatttgatttggtttccatgggaatctgtgtttgtgtgctcaccagggctctgtgggaaatgagctgatgtgacccacagggcctccgtgtggagtggtggagggggctggggcagcaccagggccgggcagggctctggaggtctggctcccgttctgctgcaaggcctcttgttcagcagagctgagctggtcttagggatgtacaatcccattcggtgggggggctgttttccctccttttcttggaagcggaccagctcacagggaaaatggaaatggtgaccttttgctaatttctctctttccacacagttgcttcttgttttcatgccccatgactgaaggtgggcagaactcagacagaagcctggaaatcctaaactcaccatttcccattctcgccctcccccagccctacttcctagcaaagccattgggacttagagcaaacccttagagtgacagatggcaggaacgctcatctggatcagcacaaaatgagactttggaaaataaacacagcatacttctgcaattctgctgtgggtttcctaggagcaccctccaatggaacaggagaggtggggctcatacccaggcctccgaggtgtgtccaggccaggctctgccaggctgacctcactcatctcctggtgtcccagaaagggtgcagtgagcggcagcgagtgcagacccagccctgtcatttgctactcgcgtgtccttggccactcgcttgacctccctggggcttagtttcgtaatctgtgaaacagtggggagcatcgctgtccctgagcacattgcaaacactgaatgcacacagcagcgggctcagctcacaggtctttgtcgccctcccctgctccatggatgatggggtctgctccatctcttcaccctaatccaaacaaagatgttcttcctaattcttgtttccttggagaactgaggtcttcagcgtgggttccagttgcatgctgtattcccaggctgacaccttctgcccactgcagcctgttccctgaccctctgtaactttgtttaattctcttgacctgatgtcaacataaaagaagactggggaatgaagcgagaagtgacaggcccagcttgacctcttgaaggtcttccattgtgtgaggcttgcaggggagtcttggctttggaagcccaaggacctatctatcttgaatcttaattctgttatctcattgggcacctatacttcagccccaaaggctgttcaatggctgtcatgatatagcacaggagacaaagctggctttatcagacttgctcagtaagtgggtggctgtctttttatcgtgttcctcctggctacacacacacctcccctggttatctctggtactttatgtgttctttactccttttttttttttttttttttttttttttagacagggtctccctttgttgcccatgctggagtgtagtagtgtgatctcggctcactgcaactgtgacctcctgggctcaagtgatcctcctacctcagcctccctagtagttgggactataggcgtgagccaccatgcctggctaattttattttttgtagaaaggaggtctcattatgttgcagatgctggtctcaaactcaaagttacaggtgtgagccatcacacctagcctatgtttgttacttaatggaatggatcattaagatgaatggcactgctgtgtctccacctcctcctccatgggcataggcgatgaaccaggaaaatatagggggaggagtgtatcattttatgaaaagatggtggggagggggcaggcccctgacattctctcttgagcctctgttcccatgatttgcctttcttgctgccatgggccttgactttatgctgatgagccatagtcagcttcctggacagctgttccagagggcaccgtaactgctctggccatgcttggaccccacttgctagactgagggagggtcaccaagcccaccaactgacttagatcctgggtatgcggtgatcctcttagagcctagaacggtcggcatctgcccagggcctgctgggaaggaggggattaccaggggcagcggggagacagtcacagctggcctccagagcccctccggatcatccagagagttgacttaagccagtggggctggccctgggagcttcacactaatcatctctggagcggttgtccataacaactgacatggagggaaatgctgcagcttgcaaaacacattcaggtctgtaccatggttttagtcttgggagcatcttaatggagcaggaggccttgtcattgacctcagcttacaactgatggcagggattgtcagagaaggctgataacttggccaagggcacgtggtggttatatcattaggataagtattgctcaaaaaacagtgctgtgccaaggaaatgtttgctattctcaccaacctagaaagctaacaccccagctatgaatgtcacccagcccagctggagttagtccttacagcttcctactgtcacctgagcatgcggctttggtcctcagattggtaggatagccaccgaacccccaagcatctcatccatgttccaagtaggatgcaggcaggagggtgaaaggacaagaatcaaaaggtcaagtttgaccctttttaaaaaactctccttgaagctacaggaattttctgctggcatttcattggccagaactgaacctcctgaccatctttggttacaagggaggtgagtaaggaaggggaccactttatcaggcactttgctgcttagtacatcagttggaattctatcctcaaaaagaagggaacaacagatgtttgggatgccaaccaacagagtctgccatagttttaaagctcccaagccagggttgacagccaaagagatgaaatctttaaggcatgcttggtgttaggtcctgtttccccacttgacagcttccaggcggtgtagaccatagtggtacgtgccatggttgctacttgccagcatataggcagtgtagactgtaaatctctaagtgtaccctccgggccagactctgtcaattggagagccagcctttccctctgggaattggcggcctggctggggaggcagctgttacacatatatttgtaattgtggtcgtgctgcaaagaagagaacagggtttgcatggcatgtgtatggtgggtagcaggaaggaggaggtgacgtctcatgtctgtgctgaggtgtttccagtgttggcacacttcctcacaaagacacacatgcgtgcagtttgggggcaggtgcctgttttaggaggatgggagcagcagatattatttctcgattctgtttggtagtggaacagcctgtgctgcatggatggccagtccttggagacgctggggaggtacgagtgttttgcagtcaaataagtgtgggaaatctgacttgctgcatcccctttagggagtcacagtgcacgttgcagagaaaggtttccttcccctcttctgcccggcacagaatgtgaaacaggatgttaaagagaacaggctttggatgcagacattcgaatccaagcttggttcagatcctgccccattattccagctgtgtggccttggatgaagtccttaatctctctcagcctcagctttctcatctctgcaatggttgttccgtgtatttaatgagaaaacacgtgtgagaaactcaaagcaggcatggggtaagatgcagtggctgtttattactgcccccatccctgccatcacctctagacttgaaagagcagctttctagactcttccagagcaggtgagaggaaagtgtgtgcagccaggtttttgtcttttcatcctcttgtctggatcaggccctgtgagcagggtcttctgtggcctggtcctgaactgtggaagagctgggtgtggggctctggatggtggaggagttgtgtttgtgttgccagccttgtcccagccagaagttggggggtccctcatgagcttcgagacaggcaatttgctctctcaggcaagaggacgaacagtgcaccttgcagttctgatgttctgggttccttgtgctttctctttgggaaaacatagaagacacgggatgggttcctctctccagaacactgagtgattgatccccgcagggacagaaggacagaacattcctttgggactgaataggacaaaggcctgtgtttgtgagtgttgtaattctcccattcaatctcagacagtcttcttgactggcttagaaccgcgtgcgtgcacgtgtgtttgttggtgggtgtgtttgttgtgtgtgtgtgtgtgtgtgtgtgtgacttaggggatgggacttgggtacagggaagatgacaacacttgcttttttcctcctcctcctgtgtgtgctggggggccaggaactgagtggaggaccgatgggggccagcagaccctggcacaaaggagcaagggcccagcggagagagttcgaatcctagttctaccaccacaaacctatgaccttgggagagtcccttcaacttctttacctataaaatgggattgatgggcctcccggtggcatggaggtctgataccctgccttactcttcgtaggcgcttagcaaatgttctccctcacctctgctcacctatgcctgggaagcagccctgcccctgtgtgaccttcaccacttcacttccatgttctcagacggggtctttgtccttcccaccaaggctagcaatgtcgaaagcctcttttttgagtcctgctcaggctgaggtttggggcagtgatgaggcagcagccagggtcctgacactcatgagctggggtgaagtgttagtgctctgtgaggctctcaccaaccctgggggtcttatcaggagggagctgagcatctcatggccaatccaagagcagagtggggaagatcccaacatggatcgatgcccttaggagagaaagttcctttctagggtgtaatgctcaccatcatctgtcgggatcagatctcttatccagcagataccgggtgcccactgagagcaggcagctatgcagaggcctgtggacagaaagtgagtgagacctaggcagcctttccttcttggactgaggaatagatcctccagtttagttctggttccatggctgtataattttaagaccttcaaagagatgagtcaaaaatctgctacccactcgcaactccgggggctgccagggacattcttgatgccagctggggtggcgtgtcccatacctgctgccacattagtaccctctgctgcctgcaccgggagtccccatcctgcctggtgctgtgctctgggctccgtgcaggtgactcctctcctgctatggagtctggggtgcaggcggccctcccagctcaggggtgaggacctggaggctcggaggttggggagtggtaggacttggatttgaactccgatgtccgtggcggtggggacaccgcctgccctggcctgtcttttagagggagccatgtgggtcagctggggagacaatgaagaatgtgcccccacaaacaaatggacctttgttcccacagtggcttcagggctgggctgggcccagcagatgatctccggccccctggaagctgggccactgctccctcatctatggatttttccagtgcctgttatgggcaggaaagaagtgttgggccctgaggggcagagaggggagaagggagatggggctgagctctgtgtgccaggggacttaacggtgttgggggctaatgcaggtgccaggatgaccccgtgctgggcgggcccgggtgctcccagggggctgggcctggccctgtacagtgcctctttatgtgtcaccaccctcacctggtaaccactgctgcgtccctgtgccattcaggaacagggaacttttaggtaaccttgaggagggcggaaacccagggcaggcgagtgaagtggcaattgagaaagagtcacgaccaccctctgcaggagtttagatgaacatggcaggtgagagattggtccatgagtgagctggggtgcttgtctcctttctgcagaagcacgatggtggcctggggctggctggcttcggggttctccaagtgagtgtcgggaacccctgcactcctccgctggggagggggaggtggtgagttcttgttggaaactcagtacggagctttcatacgctgcgggggaacctgggaattggatgccatttttctttatttttgaacttgttcctcaggttgagaatcgttggtcttaagggattcaggaggctttcctggtcccattcccagcaaccccccagtgggttaaatcctctttctcctttctcagaggacccagaggaactgcagccccccggggccatttccactgcccccactagcttgtgagttgtcacccactcgtccctgcggggacaaaggggacctggcatacaataggtgcctaatgaatgtttctcagatgaaattgaactgccttaagtatcaggggtaagaagtagcagaggtggaatccgatcaccagcgggtgtggatggcgtgggggtggctgcctcgtaccacttcacggggggtcactcacagatggagcagcctacattctctgggccttcagcacctctaggaggtaggaagggccaggctgttcctgttttaaagattcaagctggggaggaggtgacttgcccccacagggtgcctaagtggtgatctgtcccatcccttcttctcaagcgtgagtttgtgaacgctgaccttcctctctgctgccacacggcagtgatctgtatgggtcgcatttctgccagcttctagaagcaggttcaacagcatttagagtgttctgtgttccacttcactgcctcatttaatctttggaaaatcaatgcagcgtgctgagctgaggtggcctcgtgaggcctgagtgtgcgccgcttgcgggcgggtcaagtgctgagaagcctggggccccgcggaggctgattgtctgggggacctgcctctgtgctgcctgcccgtgtgactctgggatactgacttcacttcctcagccagctgggtcacatggctctggcagggctcctgtgagggtgaggacatggagggacatggttcagcactgccttgacacctggcaggtctcagcagcctgatggccttgcctcctgctccccaactgccctgtgggagcagagcccagagtggggcacttcaaaggggaggtcactgctctcagatgtggaaattgctcaagggagatgagtgactggggtcctcgggaacttctggttgaccttgaggagggcggaagcccagggtaggcatggggtgaagggtgagtggaagtgacaattgagaaagagtcacgaccaccctctgcaggagtttagatgaacatggcaggtgacagattggtccatgagtgagctggggtgcttggaaccaaggcagggtgccttttttttttgttttccagaggaagaaaggtgagcaggtcttcagctgttaggaaggtttggtgcggagaggtgcagggatgactgggagtaagctggctgggggtcactggccgagctggagagttggccttgacccagagaaccatctggctcaacaagaaggaagggcaggagggaggatgggcatggtatcattcagaatcttttggtcaactcaacatggcttacatgggattggaagttggtgggccgtgtaactgaaaatcccaggtggtggatgccatccccaaaccgtctttcactcttttccatccctgggctggccatactttcaggcaggcccttgcctcacggtgacaatgtggctgctacagatccagccctcccaaccttgctccatcaagtccgatccagttccccaattactagaaataagtgcagctggctttagttggcctgagccaacccatgtgttctttcctgatccagtccttgcaactgggaggtggagtgcatgaattggccttgacttgtgaaacgtggggaggggggtcactgtcaacagaacacttaggactgagggtgagggttgggtgggttcctgaaggaaactgagggctgttcttggaagtggggagtgaattctgtgtagccccaagccagcagatgttagtcacaggtacagtaacctgtggggccagtggggcctgagggcaaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccgtaagttctgaggagctctgattccctgtcagccggttcccaagagagtggcggaaaaaggcagccgagaagggctgatggccgggagctggtggtttctttttgcctgggacttcctggggctgttctgggaagaactcttgccacagcctggaaaagccagaaatgcgctgcatgtgggcacggagttgtctgtgtgcccggaggcgctgggaacacaggaagctgtttgctatctgtggcagtgacttctatattaatgcacgcatatggttttcagtcttttcacagaattgtgcaacgatcagcacaattttggaacattttcatccttccaaaaaatcctgtaccttttatctgtcaccccaccctcagatgactgacccttcattgactttccttttctgtgaatttgcctgttctggaattttgtatacattgaatcaaataatatgtgatttttttttggtaactggcttctttcttagtgctttcaaggtttatccaggccatgcattaatatttgtatttcctttattcctttattgaataataatattccattgtatggatttaccacactttattcgttcttttttctttttctttctttctttttttttttttttctgagacagaatctcgctctgttgcccaggctggagtgcagtggtgcgatcgtggctcactgcaatctccacctactgggttcaagcaattcttttgcctcagcctcccaagtacctgggattacgggcacccaccaccacgcctgactaatttttgtatttttagtagagacggggtttcactgtgttggccaggctgacctcgaactcctgacctcaggtgatccacccacctccacctcccaaagtgctgggattacaggcatgagccattgggcccggccatctattcttcagttgatgggcatttggggcattttcactttttggctgtgtgagtaactctgctacgaatgtttagactgtgaattccaagattaccaggagggttttcttaggtgggttccccatttttcatagatgagaatggaatggaagctactgaatgttgaaatttcatggaatagaggtgaattcttctgtgaggaatcagaagacacaggtttcactggtcccgtaatttttatgaacttgagtattgcaagcttgcttgatttttgacgatggactgcctgattttcatttgtttctataaagcttattaataccttattaataccttgaggctggggatggtgtcactgaaatccactgaaaacactttttcacttcattctcaccttcttttatctcacttcttcccctgtctgtttcccttatatccattttgtaccaggtccatgctaggtattttgatttacactatctcattttattgactctgacaaggaactggaattgcatatggcagcgtctctccccattcggagaggctcattgttggtttataataggcttaccactgtaacaaaagatgccaagccctctgtggcttaacacagtatatgttttatttctcgctcatgtaacagtttagtgggtgtttagtgggacatgttctatttggcaattcaaggacccaggctccttctagcttgtgggtttgccatcccctggggctgcagagccttctgctggaaactgtgcttctggcaggtagatgagagaagagagaaacttagaggatcttagagaatctgggtggcaggtatggtgaggaaatggtgacggtcacaggctatcggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaaattatgtgtgtcctggaccagtaccccagatgggagggtatagtggacccagatggaaagagaggatcaggagggcaaagccatctcatgccagggccatcctgaccctggctgactggaggagctacaggagccagcctgggaaccccttccagcaccaactgcaagactcatctgccagctaccactcccttgccccatgaaacttactcttgctttttatcagcagaggaaagtgggcatggggacaaaaccaaaaaacaaaaaacgccaacatctgtgttcttctaagttcacttcctacttctgaataggaatgaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtgagaggcctcttgccctatgagctctacagggtggaaactgggtgtcggggaggggttcaggtgctttgctcttttaaatactttttaactgtggtaaaatataaaacgtatcatcttaagcactttttaaattgtgggaaaagatacataacataaaagttagcactttcactatttttaagtatatagttcagtggcattaaggacatgcagacattgttgtgcagccgtcaccaccatccatctccaggactttttcatcttcccaaactgaaacaacatacttatcagatactatctccccattcccccagccttcctgcaaggctggcgttacgataggtgtgctcagcctggacaggacttcagtggaggaggacttgacaccaccaaatagtgtgaagaaaaacctagaagtctggggagaaacagagagggagagaagtaacattgatggagcccttcctgtgggctaggcttcatcatttgtgtctaacactgggcttaatccttacagctagctctgtgtggctgctgttgttagctccattttccagacaaacatattgaggcatggaggcattaactaccttgctgaaggttgcacagctgaggccgggcatggtggttcatgcctgtaatctcagcactttgggaggccaaggtgggcggaccaccgaggttgggagtttgagaccagcctggccaacatggtgaaaccctgtctccggccaacgtgatgaaaccctgtctccactaaaaatacaaaaatgagctgggcgtggtggcgggtggctataatccctgctactcgggaggcttaggccagataatcccttgaacctgggaggcagaggttacagtgagccaagatcgcaccactgcactccagcctgggtgacagagcaagactctgtctccaaaaaagaaaaaaaggttgcacagctgatgactggggagttggctttgatcctatctactgagacgtgtatcctctttggaacatcaggctgccttagttgagagtatttgcactgcctggcccttgtcagctcgtgatctgtatgggcatggcctttcaatttccccttgtgcaattatggtcaagcttgttggatcccccaatcagcatcatgtgggggtggcagacctcagagataacccctcttgtccctgcacctgacctgtgtttaaactagggcaggagcaggttcttgggcttaaagtcttccagaaggggccttcttggcatttataaatagatatccttttttattagtgttcagaattatccttaataattaacctttatcagagaggaagggaagggacagccaaccgtatggggccaggaccaaaaattaaaagtgtattaaaacagtgggacgtggttaattgttaaccagcagataaagccagaggtgtgtccgtaaatctttggttggaccagttgtgtgaaagacttgggggaaagcagagactcttagttccccctggtgaagttttacaaatattctgaggcctgagccccacccccaggaatttttattccgttggtctgggtattacagcgcattttccccctagtttactatgtggttttcgtgtgcatctggtgggacccactgtcagagtgggacctgacttgtttcttcctcctggagtagggcagaggagagtgtggggcttgggaggggtgagggagcatctcccaggccctttaagggtgagccccctgtattctgaagccgagacagcagagcagggtaggggatccctggctgggctcctcctggccccggtgtccaccacctacacaggagggaccttggaagtagaattctgctgcttcctcgcctcacaccagccctggggaacagggaagaaacagagggccctgcaattaagtggcttctccagtgtcacaccttaggagctgctggctccaaattgagccatggccatttcagaggagcttcatgtctttgccgcacttctgccctgcggcttctcagctcagtggctctgttgatgtggagccacaccatacgggctctttctggctcttcccagggcgtccgcatacactgcttccctgcccacacgctttactcatcaggttcccatgaccccttcagcgtcacttcttccaagaagccctccctgatcatctgagcacggcaggtctctgtttcgataggctttgttatgagtaacaccccctgtttctgttgactcgagggctggctcctgtcctggtttgcatctgctttgctcacagacccctgccattgcctcaccaagagcccggcatgtgtgaggatcaatcactgctttgcggatggaactcattcatgcctgttttaattccttctccctgacattggaattgtgaaatgccttctagtcagtttctgcaacaccctagacccaaaaccagacaaacacagtgaggacatgtttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtgtgctgcaggggtcttggaaggaggatgcgaagggactagacttgggggtgggggggtctgggtgcatggggcaggctgctgcatggtccccacccttcaagcgtgtccctgtttggattacccgtttctgtccgggcgctcactaatggcttctctgtgtcatccccaggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctgagctctagtctgtctcctctaacttcagttttcctcttgcgtgaatgttatattgcatgatggcagctgccccacccatttgctcttgcctcctgttcttccattcccttctctttcccatggaatgttctggaatggagttgcctgagtccttagcttttctctccacaccctcatttttccagtgttcctctctgtcttgagctcttcaaagaatgataacttcatggttcttgctcaatttgttttcattccaagttttagaatccaaaataaagcttaagagtgggaagaaatgatgccgtaacgggccttcccgtaaatgtcagacggtctctcagagcctgggtggcggccaggagggaagtgaggagaaggggcgcggctctccaaggtcgaggtctctgtccagtcctaaagcatggtgacctcagagctgtgcaggcagttacggcagcatgctcccgcattgcctagccaggcggtcaccctcaggaagttctaagtgggtccttggaggctcccgtcactctgtccttgtgtgacatgcatttgtatttttgcttccaggctgaaaagcattattggcatgggaacaggagcaggcgcctacatcctaactcgatttgctgtgagtgctttggcattttttgaaaatcgcattttaaataacattttaagatgaaggaagacattggaaaagcatcaaaaacccaaaagggaaaaagaaatgacccgtattctccacagttgtgtgtgtgtgtgtgtgtggtgcatgggtactcgtatatatatatactcacagccttttctcttcctccactcaaggatgatactggacacattcctttgtcatgggctttgtccgcttagccatctagtgaggacgctcctcactcactgagtactctgctatgacactgctttgtaacagctgtacaggtttttgtagtcagggcactcctgggtcataactgattctaaactagaatcagacacgggaagttttcatgacagttgtcattgttatttctctgggctcaggtcaagagccactgttcctttgtatcctcaccgagcaattgtgtaagaatgcaacaatactcattttgtacatccattggtattttgactacctattatttgctgggctttgctggaggttgggaatactgacatgattctacaacatccatcttacaaaaaaaagaaaggaatgctgacatgaatacaaaatggtctggccatataggctctcagcaaattaaaaatggtctcaactgtaccccaggtgtacatatctatatctgtatgtatctgcatcacataatgacattttggtcaatgacagactgcacatttgacagtggttccataagattataatggttcatttttactgtaccatttttatgtttagatttgcttagatacatcaatacttagcattgtgttgcaattccctgcagtattgggtagcgtcatatgctgtacaggtttgtacagcaaacctaggagcaaagggctgttctatacagccttggtgagttgtagactatactgtctaggtgtgtgtaagtatactctgagatcttcacacaatgacaaaatctcctaatgatgaattttctcagaaagtatccctgttattcagcgatgcataactctgtctctctctctgtgtgtgtgtgtgtgtgtgtgtgtgtgtgtgtgtatgcatgtgtttatcctggaagtaagtaatacagttgttactgccacaactagagagcatttgtgctgtgcgccttgtttgattgatgaggtcgatggtgtgttacacccatttgatagctggagaagctgagcctccgtgggttgaagtgacttgcccaaggcaggcctgcaaagcagcgggcttcctacttctcctgcacttcctctttctccttcccactctctctaggacccgataccgtgtctgctgtgctggaacctcagttttgcatggggtggggccggggagcagcagcctgctctgctgcccacactgcctttttctgggtacttctctcaagctttggtttgccttggaaagttcctagtgtttcagattgctgggatgtctgtctcactttgtgtcttgaattgcagctaaacaaccctgagatggtggagggccttgtccttatcaacgtgaacccttgtgcggaaggctggatggactgggccgcctccaaggtgaggtgggggcctgtcaggccggcgggatccctgcaagaagagggacaggtgcacacagcctctgcctgggggatccctggagctacgagctctctctttacccactcctccactaccctctactgcccactccagttccctctgctttacttagaacagtacacatgacctcagccgtttgccattcagaagacttaaataccaccaagctgtctaagccagggaaagcactgggacacaggtccctgaggcagcttggagaagcattgcttggattaatgagtattagctgggtacataacttgtgccaggctttggtcaagatgctgagcatcttgaagaacaagacttcttgagatgaacaagacaaaagcctctaggaatgaatcttaggaatccattcacatattattaaagaaaaataaatatgtatttagtacggactgtgccacagaattttacgataataattagctaacgtagattgagagtttaccatgtgctagtttcattctacgttgctgtgtgtgcatgatctcagttaatcttcatagtaactctaggaggtgagaatttttatcaccgtttcagaggtaaggactcggtgtggctaaggggattgtccagggtcacataaagctaggcagtagaacggggactggatgcagcttgctttgactttgtggttcgtggacctgaccacccgtgcccctggggctcctgtccagggtgggagacaggcaggcctggcaagcagggtaggctgcctggaggagaagggacctgtgctgtcttgggaagctctgtcctggctggtgtcctaaggttccttgtttatcttttaaaaattatcattgtggtgtttttgtttttgtttttttccctgtaaaggcctcagtgttggccaaggagagggggaggtcattccagttgaaataggacagagtctttcaagctgaggtgatcgcagcttctcattctgcaagtgcatttttgcccaattttgggtggctgccagggaccgatggtttgaaggggccctgcctcttgccccatcccctgccctgtaccagccactgtgattttgcatttgttctttgaacattcctccagaatgcaggagcccttccgtccagcctgtatgacgttctggagtggaacacactccctgttttttatttgattttccagcaaaggaagtgacattccagtcaacccgctgggcttcatgatagctgtcctgagtgagactcgaaggtctggggatgtcgaccactggctaatgtgaagcctgaggattgtctttaatagctgtactattcccttcagtacagctttaatagctgtactattcccttctttttcaactccagcctttcgattaccaggcattggtattagatactgtgatgtgtgcagttacttcttgcagtccttcccttgaccttgtggccttgaagttcctggcactcccagttccagattagaagtctgagacccagaggtatgcagactgcccagtgccacacagctaggctgtggcaggcaagggccagccaaagacccttaggtctagagcttctctcctactcatttttgcctaatgcttaggtcagcacacatttatggagcttctgctgtatactaggacttatagagctcctgctgcaaacctagtcactggggagaggtaggaaaagaagattgtcagtgtctttggtaatatcagtatacttagaaaggggaaactggcttggagatgagagaggagggatagttgggagccaagcatatcttggggtatagactggggagctcagtgtgtttttagaagaggtgaatggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggtgagttgcgtggtctggcaaatctgttgttcctgctgagcaaggcattgtgtggtgctcagcacagggccccatgtgggggtggagagaacaagacacaatcaactgggggccaccgagctggtgctcatgagataatgtgacattattcattcataagcaacaagtcattcattctctctcttttttatgtgtcttttaaaaacagctgattgaagtacaattaactgcacatatttaaagtgtacaattgacatgcatatacatttgtaaaaccatccctgtaatcaggagaataacgtctccatcactccaagagtttccttgtgccccttgatagtcctcctctccctcctcctcaggcaacttctgatcagcattggcctctatagattgctttgcaattcctagaattttatataaatggcattatatagtaggtactcttttttttttttttttggtctggcttctttccctcagcataaccattttgagatttgtccatgttaatgagtggatcaatagtttattcctagtcggggtgcagtgctcattcctataatcccagcactttgggaggccatggcaggaggattgcttgagcccaggagttcaagaccagcctgggcaacatagtgacaccttgtctctacagaaaaattaaaaattggccaggcatggtggttctgcatgcctatagtcctagctacttgggaggctgaggcaggaggattgcttgagcccaggagtttgaggctacagtgagcagtgagctgggatagcccactgtattccgcctaggtgacagagagaccctgtctcttaaaaaaaagtttattcctttttagtgctgagaagtattccattttatgtatgtgcaacagtttgtttttccattcacctgttgataagacctttgagttgttcccagttctgggctgttataaatctggtcagtagcaaacatgtccgtggagttagctgtgtgctgggctgggctcagtcctaagagcttcacaagtgttaactataggaataggattccacccaggtgctctgtgacctgtgtgataaattctgttctcattcccagtttatggaagaggaaacagaccagagaggttgagtgacttgcatagggtctcaaccagggagaggtggggccggtattagaacctatgaatctggcttcattctggtcaccacagcaggatggcggctgcctgtgctgctgcctggctctgagatgagctgctcttctgcagagttaccccactaaaggggattgagccaagcccctcacagcatgctagaagtgagcagtcatcttatcagcccagcctgcctggccccagacactggttttgtgtctctagctggggccagctaccctcgggaagggtatgccatgggcttggttgcaagcccagggtctggaaaaccccttggttgcctgaaattgcagtgacctgctttgcttacataccactgtctgcttctgagctaacatgtgtgaccatctgacactcccatgagtcctggggacacagcctccactctggagctggcgagtacaccaggggaacagacgccccactctggagttgacgagtgtaccaggggaatagaggccccactctggagttgacgagtgtacgagggcaatagaggccccactctggagttggcgagtgtacgaggggaatagagtccccactctggagttggcgagtgtacgaggggaatagagcctccactctggagctggtgagtgtacgagggaaacagaggccccactctggagctggcgagtgtacgaggggaatagaggccccactctggagttggcaagtgtaccaggggaacagaggccccactctggagttggcgagtgtacgagggaaacagaggccccactccggagttggcgagtgtacgagggaaacagaggccccactccggagttggcgagtgtaccaggggaacagagaccccactctggagttggcgagtgtaccaggggaacagaggctccactctggagttggcgagtacaactgctaggtttgcctgttgtgttggtttcctgtggcttctgtaacaaattaccacaaacaggatggcttagaacagcgaaagtgggatgagcagggtggctcacacctataatcccagcactttgggaggcttaggcgagtggatcacctgaggtcaggagttcgagacgagcctggccaacatggtgaaaccccgtctctactgaaaatacaaaattaaccggatgtggtggcacgcgcctgtaatcccagctactcgggaggctgagacaggagaatcacttgaacctgggaggcagaggctgcagtgagccgagatcgcgccatgcactgcagcctgggtgagacagagggagactctgtctcaaaaacagagaaaaaggaaaacaaaagtgtattctctcacagctctgagtctagaactccgatgtcaagcgctggcagggccgcccctccgccacaggctccaggggaaattcgtccttgcttcttactgctccaggtcgctgtcggcattccttggctagtggctgctcacaccactctctgcctctgtcttcacatggtcttctcctctgtgtctgttttatttctccctctccttcctcttttaaggatactttccattggatttcatcccggctcatgtaatccaggattatctcatctcaagatccttaattaattacacctgcaaaaaccctttttcccagcaagtttgcattcccaagttcaagagatttgacatggacatatcttttgagggccacagtttagcccactagagtcctctttccccttttacgattcattccacagcgtgtgacacattttccctgtcctgagtgtgtaatctgaaactgataggaattgggaaaaattcacagccactgtctctgtttcactggaggagggatgtcagacatagcgttgagcatctgatctgattataccccaagttatttggagactggttggtccggccatggtgtctgagggtacccccagatcgctatagttggttttgatctgaaatcccagcgtgattcctgactattttttccagagtttgctcttagtagccagttgacctccttgctgcctaaatgatcctggactgtttgatgcagctcaagcttgacaccggctttctttgacccccaactccaacttctcatctggttgccactggtcatatcagacccttgtgtgaaacctacagtgtctgccctcgtacaaatgagaaacagagcaaacaagttgtttgtcgcaaataacattcaaaaagcacccagagacggggaggctgaggccgacttccccaaggctctggttggccgtggtgggagttgcaattgcccttcttttcagtaacttcctgtggcatgagttgattttgcttttcaagcatgaaaaacttcttttcagctcttcccattggaaaacaattactaacatttgcctccaatttttactgttagtagaggtgagaacacaacctccattaagtcctacaacctagtgaagtaggcaacattctctctcttcccttttttttttttttttttttaagagatctgaggctcagagaggttgaaagatttgcctacgaaagggacagtgatgaagctaagctctagatccaggatgtctgacttcaaattgaaactcccaaagtaatgagtttggaagggtggggtgtggcctttccaggatgggggtcttttctgctcccagcggatagtgaaacccctgtctgcacctggttgggcgtgttgctttcccaaaggttttttttttaggtccgtcgctgtcttgtggattaggcattattatctttactttgtctccaaataacctggagaatggagagagtagtgaccagctcagggccacagtgcgatgaggaccatcttctcacctctctaaatgcaggaagaaatgcagagtaacgtggaagtggtccacacctaccgccagcacattgtgaatgacatgaaccccggcaacctgcacctgttcatcaatgcctacaacaggtattgggatgtagttcagccacatcattgctatttatgaggtgtcttctgtagatccgaaatgtgggacagatgagagggagagtataaaatgagcggaagaggcaggctctgagtttgagcaaatagattaataggacaggtgtccccaggaaggacacctggcctgtaagctggttcctggcattcagctcgccttgcagggatctgaacaaacactccagaccactgggggtgcagacgtgagagggacgcagtcgcacactcagagggttgagagtaaatatgtgtgcccgctgctgaccttcacgaaaggccaaatgtaagaagagctaagtgagagagcagcaaagcactcctggaggccggggataatccaggcaggcttctgggagtttgtcattccaaggataaggaggacctgaacatggcctttgcctaaggcgtggccctctcaaccagcactaggtgcttatctggagctcagctaggggaggagacagctcagggccattggtgtcagccagagactctgtaatcttccagggagctcgctcaacctgctgagctcgctctgccacgctcgcagaacaggagatagaaatgagcctcatagtgtttatctctgctcaaatgttaataaagtgacttcttgaaattaacatttgtaacagagcttagtatctgcctccttttacaatcctgccctcatctcagtggtaacatcctcactgtggatgtgactgaagaaaccgaaacctggcagtgcggttcacttagtaaacactttctgagaactggagcgagtcaggcattcggctgggcgctggagacacagaggaaaccagcacagcccgcagactccacactgttaacttgcccgtgtagatagcaccgtaattaactgacccctctccaaatcccactgtgaaggtcctggaattactgtcatttcctgttgaggaagcaaaggcgcaaagagatcctgtgttctccccaaggccacacagctagaaagtggcagagcatgatttggatcctgcttgtctaactccaggctgtgagctgggaaagagcttctcatgttgggagctgcaagatagcagagagggtgggtggctgcgtgcaggaaaggtggtcggcactgggctggacccacactgggcctcacacgagtgcagtgggaaaccaccacagggtttgagacagggaatggaaagatgaggcctgagttttaaagagatcatttgggtgctttatagaggactcagagttggtgaggctgggacttaaactaagaggctgcgagagcatttgggaggtggcccctctgtcaggtgggggctctgactagggggacagggaaggcggggaccctctatggtggagaatctgacttctactcctggaaaaaaaagccccacaaatatttgtgacaaaatgagggggctctgcttgaaatgcatgtgttgtgctgtccctctaaccaggtctgtggacaccaagagggtgtggagtcctgaaagccacagggcctctctcaagttggggatgtgggtagcttaccagaatggccactggcaggacctcctgggcttggctggatgggagtgggagatttctccaggggaggggtcctcatgctaatgatgcatttgtttcctgcagccggcgcgacctggagattgagcgaccaatgccgggaacccacacagtcaccctgcagtgagtggcttttctctcccccagcacttgcagtcggggctgcccactataaaggtggccttgctggcagggccttctttctgagtgtggcaggacattgtgtcagtgagacctggatatattccacccagagactgagcattacccagcctgacttggacttctccctgtgccggtggcatccgtttctagggtgtccccatgacctaggcctttgatcttggagaaggatggttgattgtacttgggacagcatttattaagcacctactacatcaataactgtgtgaggctttgctccatgaagcctagggatggatagcacaggacccagccttaaagtgctccatacacctaggaggaaaagacagtcatggacagaactaactgggtttccaccagtaatgatggtgtctttttgtggctgagtgcaccgcgttgtgtgacacttgggaacctggcacgtcattgcctttgtccttcatgctgttcttgtttcggtcttgattgccagctaagtcctgcttaaccatccttgaggagaagatgctttaaaacaaaagcactgagtcacagaaattccctggctgaaattcatactaagttgtgaatgactagtaaccaatgttatcctaagatcaaaggagaatgaagtaaaagagcaaagggtgttggggaaaccaaaatgacattgtttgtagaatgcaggccccagcctggcaggcctgggagtgggacaatctttaaaggaaccttgtgctaattctctgctctatccctgaccccaggtgccctgctctgttggtggttggggacagctcgcctgcagtggatgccgtggtatgtagaaatcacagctgatttctgtgtttaattcaacaggcaaagtctggttgactttgttgaagtggccctgcctgcccctcctctcctctgccccatcagggcaggtgatgttttttgaaatgccatattggcctttgggcagagggcccagccactcagtctctttccctggtggctgccagccctggttgcttggcagtgtctcctctcccaggtcccctcacccgccagtctgtgtcccatcggcttgtttatatgggcatgtttgccacttggcttcctggccaagagactcacctcttatttgggaagcagctggatctttccaaactgactggtgcctgatgagctggcaggggagagaggcactgggaggcagggcttagcaaagcttcctgactcctttcaccccttaactcccacctgcaactttgtggcagcaaagagaggaatctgcctttcaaacaaccccacagctggggagatggaagacttaggggctatggatcagagtcctgcagtactgccatgctttgtgcagtgatctgcagagtgacatttgcaaatgttcatgtagtaaatacctggcatgccttagtgaaccatgagtttcttacgggctgactgactggagataatcatgggatacatcaatagagatacactgttcaaatcaagggaggtgatagttttactttaagcattttgaacatcctgggttacatatgggtattctgcccaattccagatgcccctttcaagaggttcactgacaaaatgaagagagaaaccagtgtgattttacatgaagaatagttgttagatctgggaatattaaacctgtagaatctctggcagctgctggttaaacaaggatatttatttagcaggtatttctacagtactgtttacatttcggctaatcttcataataaccttttgaaaaaagatattagctccattttattgatgaggaaactgaggcccaaagaagttaaatcacttatccaagttgtcacagctggtaatggcaaggctgggatttcaagccacatctgctgaatcccaataactccacatactttcttctttgccagcagaaatactggagtttctggtgacggtggcagagtggcggagaagggggagatgttttggctttggcttcacgtagaaaattaacagatttcctccctcttgtgcaggtggagtgcaactcaaaattggacccaacaaagaccactctcctcaaggtacagggaaaacagtgggggttcgtgtttgttatttcttagaaactctcagacgttttctgcaacattgagttaggcttgaaaaaggcaaggcacacgatcagaaactatagaattaatgatttaatctatctgtttatgaacatatattgggtgctgactggtgatctgaggctgcaaagatgagggatccttctctgggactgcaggaatcaataggctgctggtctgggggctttggggatagagggaccagggatggcttggcaagggccctccataggctggggccaggacattcctccaagaggggctctctgcttgtcacaataagaagagacgtgtcccacagccggggaaggtcaggactttgtccagcaagttcatctgagcacatggtgagccagctcactcgcagctggatttgagtgtctgtagcaacctccgccagtcctttgccagttatgactgattgcacaatgcaaaccactggctgtttgtggcggcctcgtccggagatgcagcccaagagtgggaacctttcagaggggcctctcagccggggtgcacccctgcaggggcagatgaccaggcgggacctgggtggagatgaggcggctccctcgcactgggggaaggacaaagaggtggcatctgtaggtcaccgtgccctcaacttcccccatagaagtagaatgcctttgaaaggcatgtagggggtgtccgatacttattgagtgggaggctgttttcctgtattgggctctttacatagattttctttcaagattccctcaaaaggaaattgcaagattagaagctgctgggcgtcaagcttgcataatgccgtactttgagggcggttgtcacaagtatcacaaaatgggtggcttaaagcaacagatatttattcccttttagttctggaagctaaaagtccgaaatcaaggtgtgggcagggccgtgctccctctgaaggtgctaggggagaatgctgcctgcctcttccagcttctggtggctgctggccacacttggttcaccttagctagtagacacatcactccagtctctgcctccatcctcactcagcactctcccgattgtatctctgcgtctatgtccaaatttccttcttcttttaataacatcagccgttagctttagggcccgctctaatccaatatgacctcatcttaacttgattttacctgcaaagaccctatttccaagtatagccacagtgataggtactggggttaggacttcagtatgtctattttggggacacaattcaaccacaacctacagcaaagggtaggtggcctgactgaggtggggtggccgatttgatggtagatccagaaacagaactcacttaggcctgattctggagacttccacagcgtcagtctaatgtgctgagtgccccgcctggaggaaaaattcgggcatcctgctccctgcgtgctggttgagctgagggctgccccaggtcagtgtcgctttgtggctagtgttgggggtccacacttgaggcgccctgggctgtaggatgcccacagcctcaccactcccatgaactcctccagccccgtttcaccccaggccaccctccccgcagcctccccctgctcccttgccgtcagcgctgcccatttccaggctggctgcacagtctcacagcctgcaatggcctcttgcggttcggtgatttcacagggactttgaacgtccaccatttaggaagggtactggtcagctgaatccggcctgaagacccaaattcaaccacttccttttgagggaaactttcaagggaatatatgaagagggtcttgtttatcaaaccctttcgggtcagagagatcctggcctggaaccttgcgagtccctcaagctcttcctggcccagtttctgcctgtaaaatgggacagctgtaccttccatggttcttggggaatggagtgaaattatctgtagggcctagcatagtgcctggcacgtagcaagctgcaagtgatggttgccacggagacaccagcagccttgcctggtggggctggattgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccaggtgagtgccatgttggcttttgcattatacagctgtcgcttccccctgggtggagtgcatgtgcctctgtgacacctgttccctcattaccttgctgtgacatcggatgacagtttgtggactgttgggaaaaggtgctatataggaggactctgattccctaggaaccaacccctgtggagtaggtgatactgcggttcacagaggttgggggatttgccaagtagacacaccttggtcatcatgggtcagaatctgggtatgtctgccccaaagaccacgggcttctgctggagtgaagggccgcaaggagctccagcccagagcagagggacatggaggagattaagccaaattgtgtgtgtgtgcatgcatgtttctgtgtgtgcatgtgtacacgtctgtgtgtgtgcatgtgtacacatgtctgtgtgcatgtgtaaatgtgtgtgcacatgtacaaataaacacattgatcaacgtaatgtgtttgctacgtaactgatcccttcaatttcccctcctataaagaatctcaccaacctaacaagtaaacttttaatttgttgtcttataattttatatcctgacagttttgtgttccatcttaaaatgaaatagagttttttgtcatcttttttatccaaaacctgccctgcctcctttcttcctcctttttttctttctctacttaaaatgagaacagatgtaaccctggtcataattaaaagaattttcagagcttcagaggagtgcaacgagcacaggcttcgaggacaccagcacaggggggagcaattcctgtgtgacactgtcgtcctcatgccgttgcaggttgggtgtatgtttacacagggttttcccatccttgattaaattaggtccttgcaatagtcctcagaggtgggaagagcaagcattttatcccagtgtcacagaagaggaaactgaggccaaaagttgagagagattgcccatgattactggagctaaaattgggcccaagtgttctcattcccaagcgtgtattcttggttctctccaccatctcgaacacaggcgtccctgttccctgcagccctgacctgcttctcttgtctctttcttccactgtcacacaaattccagagggcaatttgagcatagccgctcttttaaatgtcatttggctctttgtggaatcctggcaggagttagtggagagcagggaggggggtcagcccagcctctaccagtgccctctcactgcctcaggagaataggacccagggcactggatagaacagttgggattaactgaagaacagatacgccttgcacgtatgcccttgatatttgagcattcacctccaagtttacattaaatgaactgagagaactggtagaactggatgtggtctcagcattccatacgcatttcacttaaagtagcccagttagttgttaattaattggtttgtttacccatccaacgaaccatccaaccatcatccattcattcttcttcatatcctttcttccttttatttgtccttcttttgttcatatttctctttttttcttccttttgtccatcaattctttttttaatccatctttccttccttccttccttctcttcctttctttcttttttccttccttctttccatccatccttttctttccacccatccatctatccatcatcccttctttcagccagcctgctattgaggctgacagtgatttgcctcaagaacaagtgttttaggtttggagagccctgggttaatgtacaggacccaccacttacttgttgtgggaccctgagtggatttacctgtccaaatctgttcagctatgaaatgtatctaaggtagcactgacctcgtgaggggttgtcaggagtaaatgaatgaacgcagcaaagccccttgcattgggagtggctcatgatgccgatgcagttatgttccacttgctgggttagacatgtccctttgtggatggtaatctcctcagaaacacacagaaatagctgtgatactctgccctgtattacaggtgaggaaactggctcagacaggtcatgtaacttgtccaagttccacagctgtggggtgaatttcccatcattgtcccatactcttacttttgtgttttgtcctgtcaacacgtgatggcttttgtcttgagccaaactctcaaatgaaggtgaccacaggcacagccccccatggcctcgggtgatctggctccccagcaactgactgcattttctctccttgtctctcgcagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaatagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgatgcttcggggttgtaagcagggagcagagggcggatctgtggaaattctttgaagactgtgaagctctgtggaagtggctaacaaagttgcttacattcaaggtggagcatgccatagtcaagtcatgagctttgggaagtggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaaaggcatcagccaaagagaaggaaaggaaccggtcactggccttctgcacaccacggggtgctggcttgatgaaccctttgcacacctggcatcagtgctcactgtacgcttctcatcctgctcagtagacatcccagatttgtgggtgagaagtaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttcctaaagctgccgtaacaaatctccacaaactgggtggctgaaaacaatagaaatccattctctcaaagttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggtttagggttccctctcaacccaggatgatttcatctcaagatccttaactaattacatatgcaaagaccctatttccaaataaggttcccttctgaagtttcaggtaggtgtgaatcttccgggacactgtcccacccggtacaggtgggcaggattgttcctcctcattccaccccatcagcacgtgctaccccatcagcatgtgccacttgcacgtgccatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacgggggcccagcagctggatggctgcagggatcaagtcttctctggggctggcacgtaaaagagcatgtggctggtggacgggcatgcctggctcctcacctggcagtctcctgccctctaaccggctgtctcttgttcccctagtgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 11 - DNA, 89758 bp, homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgagacgctccctcgatcccggagactgaggccactgggcagccgtggaccttctcggacggctgcggcgatccattccttcccgctgtggtggtacttctggggcgggggttccccaggttaccacagcagcctcggttccttcccctcgggagactcggcccctctccctgcgccacgcgactcccggcgcccgcgctccttcgtgccccccttcccacctctgtccctagtgcgcctcggaccgctggggctgctgcagcctcagtccccgccctagggaccaggactttcttgaattttccttcccggggaggaatcactctgttgcttttttttttttccaagttcccctgcacctggtcctccctaacgaggctaaggggaacgcaagcgcggggcgtgggcttttggccgccacagccgcagatggttcgcatgtggcggtggagagcggattttaaggcttggagctggatccgcagcgcgccaggcatttttgccctatcgaaagtcgccgggagctggggggacctccccagaaagttccggctgaactcatctgttgcgcgcagcggtgcagcattagctgccagacgtagcccggggcgccgagctttctgctcgtagcgccgaggaagtaggctctcaggtcacctcgtcgtcagggaagcttccttccctcttcttccccataactttttttaaaaagagacaagagctcttctctcaatctctgtctctctgtctctctctgccgagaatttgcagcttttaaaagtccacatcagtccaacaaattccatggttgtgtgaggattttgagttggattacatggctggcccccggatgtatgtttcaatggggaggaaggatggtatgataactgtgagactctttctcctaaataatcgactctgttacatacaaattcaatgtttagacactaacatcttacgcgttccggatagagtgaagactcttggaattttgcactgttttctttaagaaagggttgaagaagcagctagatcctcttttaggaattgatctaaaaggccaaagagacttgccaatttccacttaactgtttctggtttctccgagagcagtggttctcggactttcgcttggaatgcactcggaggggatgaaatagccactacgtgaaggggggaggggcaaagacgtggcagcagcgttctttcatcaattttttactcttttttttttttttttttaaagttctggttagaaacgtatttccccttttaggtttagacgtagcttatgaatgaggctagtcttttcctaaaataatcagatgaagaattcagtctgcatagcaggaacgttggaagttaatttaaaaaacattttaaagggatttttagaatcaagtttctatggagaaaatcggtatcctaagacgatatattcaagaagctgaaagtgaacaacctcaactatattttgtcttcatgtgaaatgtgaatacacaccccgtgatttttttttttttttttttttttttttagcttgtgagcgtaatttaagaatctgaaatgtgaacttcaaattttacttttttctttatgtgggaaaagagactttatcacttacctttaataaaattcatagtcagttttggttttgggacattgtgccttaagtcctgccattgtttttgatagctgatgacaaatgtttcttagatttacatagactaactaggaaaaggactatttctgtctcttttaaatgggtagtgctgtttttattgacattttgaaatgagttttattttgaagtactgaaaatcaggactttggtaggcggataattacattggccattttgtgttttggtaacttagatggtaaaacagttgaaaaatgtgtacaacttttaattatgccaaaaaaattagtgcaaaagactattgaaaaaaagttttatattgccttgtagtctgggttgttgcagatgaatcttggctttttggcaaggagctgttaaccttttctattagtgcagaataagttgtatactgaaaagcagtgtttttcagtagggcaattaagttcaaacggcatttattccagagatgcagcaagagctgggacagccataaagcttgtgagccttcctttctgtggaaggaatgctttattttacttagcaaccagttatcaactaggatataattattgctcttgaattgacctgtgagatacataatagtggttctcaaactattttaaggtcatgaaatcctttgagaatctgatgaaaggtgtggtcctatgtcagaaaatgcaaatacaccctacatggaattttgtatgtcacttcctgcccccccactcaagtccattcatgaactttattataagaacccctaaaaagtaagagatgtgaagttactctctaagggtatctaggtgtcttgaggcagtattgaatgtttctgaaaatcgagctgggcatgtaagtctgactggacttgtatatgtgggtgaccctaatacatttttgccaaaagggttttaacaaaagttaataggttgttagaattgttgaaatgctaaattgtctagtctgtgaaagtatatcacattgcatgccctctcctatatatggtaacttaactttggttttccattctgaaagtggaacaggcttggaagtaaacaaaaataaattgcataggctcttggcattaaactttattgcttttcttgcagtgagatcttgaatcttgtaattaaaccataatgtgttgtgtgtgtataaatatatgaatatatataaaaaatccaaataaaatgagtatgtgtgtgtgtgtgtgtgtgtatatatatatatatatatatatatatatatatattttttttttttttttttttttttttttttttgagatggagtttcactctgccacccaggctggagtgcagtggtgcaatctcggcccactgcaagctccacctcccgggttcacgccattctcctgcctaagcctcccgagtagctgggactacagccgcccaccatcacgcccagctaattttttgtatttttagtagagacggggttacaccgtgttaaccaggatggtctcgatctctttacctcgtgatctgcccgccttggcctcccaaagtgctgggattacaggtgtgatcacgccaccgtgcccggccaaagctttgtgtttctattcaagaaaatttatttgtataaattgaagctgtcctgtcattaggacagcttcagtttctctagttgaataagtattgtacctaaagaaaagctttggcaattcaaaaggactctcatttaggttactccagcagtttttaaactcggtgtggtgaaaaacattctttttcctggtcttcctttggatgatcagtatgactgttagtatatttgatttgacatttgctaaaaatacattatagagattcagacttcttacctagttgtcatcagtgaatgagttctatattgggcctttctcttcctcatgtttagtgtttcataaaaatgtgtccatattactcatttctttcttaaatagtaatattatgtggaattagtacactcagccttactctctcttttttttttttttttaagagataggatcttgctctgttgcccaggatggagtgcagtggtgtgaccatagctcactgcagccttgaactcctgggctcaagcaatccttctgcctcagcctccgggtgtagctcggggtacagatgcatgccaccatgtctagctaattttttaattttttgtagagatgggatcttgctctgttgaccaggctagtctcgaactcctggcctcaagtgattctcccatctgccccacaaagtgttgggattataggtgtgagccaccatgcctggtcatccttactctcttgttggacacttgagctgtttctccattataagtagtgcaaagagaggactgtaatttagtggtttattttatcaacctgtataattacagtaaactttaaccaattttttaatttttaaatttatatttaaatttttttttttttagagacagggccttactatgttgcccaggcatggtggctcacacctgtaatcacagcactttggaaggccgaggcaggaggatcacttgaggccaggagttcaagaccagcctggtcagcatagtgagaccccatctctctacaaaaaaaatttttttttaattaagggggcatgaggttgcatgcatctgtagtctaactacttgggaggctgaggtgggagggtcgcttgagcccaagagttggaagctgcagtgagctatgatagcaccattgcactctagcctgggtgagagtgcaagaccctgtctctaaaaaaaaaaaaaaaaaaaagaaaagaaaaaaaaattatttacaatatggccagtagactgtaggaaaatcaagaatgatgagaaatgtttcataggagaagtaggacataaaaattacatgatatagcaccatgtggctaacattttactagatattaaatctgtagcactgaatggaaatgcatatctagattcacatcctctacaaccatgaattcatttttccctgttctagtatacatggtcttattttgtctctctttacctcaacttgagaaatttggatctggcattagagtaaacagataattgaagactagaaagaggtagactgggtggaaataaaagtggaattttgacagaatagccttgggagggatgaagctgagtatacctgggcctcagagcaataatccattttttaggaggaaagggactgctaaagccagcttttgagtattctactctgacctgagtggccttggtctgaatagctcatgttcagagataagagtatatttaacttttttgtactaagaatagtatttgagtaatgttataggtacatatgagaatttggccttcatctctgccgagtcagttaaacacaagtttctctagatatttccattacaagaatcaaagctctttgatttttggaacttcagtaaaacccaagaatgaatagccgagaactatcatacaagtcataaaattaaaaggcattgaacagtgtatgaagcatcagatatcctgttacatgtgtctgcaacaataaattaaatattgattaactgattttaagtaggctcaagacttctcttacagttctaatcttatattaactagatttgcatatctaatttctccaaaaatatgatcaagaaatgtttattttagtctaggcgtggtggctcacatctgtaatcccagtgctttgggaggctgaggtgggaagatctctggagcccaggagttcaaggctgctgtgagctctgattgttccactccactccagcctgggtgacagagccagaccctgtctcaaaaaaacaaaaaaagttggtatttctaaaacctactggttgaatttaggacctcaaaatgttacttgtgtgtgtgacctttgttcttgccctatggttctgacaaccttcctcctttttatttatttatttatttatttatttatttttttggtaaactcaggcaacatattcatagtcaaaggttacatgaagacattctcaaatttacatgatttcaaaatttagttacttcttttttttttttttttttttttttgagatggactctcactctgtcacccaggctggagtgcagtggcgcaatctcggttcacggcaacctctgcctcctgggttcaagcaattctctgcctcagcctcccgagtagctgggattacaggcacccgccaccacgcccgactacttttttgtatttttagtagagacagggtgtcaccatcttggccgggcgggtctcgaactcctgaccgggggtgatccatcagcctcggcctcccaaagtgctgggattacaggcatgagccaccgcacctggcctgcagttacttcctttaacctcaaagatattttgaaaatagacctcaatttactatgcctgaatttaaaaaaccttaatattgtatttgaaaatagtgaatagtgaccattgccaccaagtagagtgatagtaataagtaaaacactaatctttgatataagggtgattactaataaattgaataaactgatatattttaacgactttattgagcaaaattgacaggacaaattgcatatatttacagtgtacaatttgataaatttgacaaaaatatctacttaaaaaaatatcagtacaatcaagataaggaacatatccatcaccttcaagagtatcctcaaggtcaggcacagtggcttaggcctgtaatcccaaccctttgggtggccgaggcaggaggactgcttgagcccaggagttccagaccagcctgggcgacatagaaagacttcatctctacacaaaataaaataacattagctgggtgtgatggtgcctgcctgtaatcctagctacttgggaggccgaggcaggaggattgcttgagctggggaggttgagtcttcaatgaactgtgattgtgctactgtactccagcctggtgaccgaaatgagtctctgtctcaaaaaagagtatacttggccaggcgcagtggctcacacctgtaatcccaacactctggggggccgaggcaggaggactgcttgagcccagaagttcaagaccagcctgcgcaacatggtaaaaccctgtctctacaaaaaaattaaaaagccaggtgtggtgttgtgtgcctgcagtccccgctacttgggagactgaggtgggagactcacccaaagcctggagattaaggctgcggtgagccaagatcacgctactgcactctagccggggcatcggcagtatccttatgactttttgtaatcccttcttttgctccttactaccctctctgtatccctaggaaaccattgtttcctttctgttgcttaagattagtttttattttctagaattttataaaaatggaattgtatatacgctttttttttttttttttagcacggggaatctccttacactcagcataatttgagattcatccatgttgttatgtgttcatagttttttattgttgaatagtattttattttatgaatataccatgattttttttaacccatttaccctttgatggacatttggattgttttcactttttgactattatgaataaagctgctatgagcattcatgtacaagttgttggagagagatatgctttcttttctcttatattaatgcctaggagtgcaatagctagatgtgatagggaaatattttttcccagttgttggcttgtcttcattctttaaacagtgtgcttcaaagagcagtttctattcacagacaacatgtctgtgactcttcaaaaaagctctagtgaataggttaattcagcagagttgtagcttagaaggtcaatatacaacagtaaattgtatttctatatactaataatgaacaattagaaactaaagtgaaaaattcccatctcattagcactaaaaaccatgaaatacttaagtattaacttttcaaatggtgtgtaatatttgtatgttgaaaattatgaaacactgattatatcatgttcatggattagaagactcagtattaagatacctactcttctcaaactgatttatagattcagcacatttctagtccaaatctcagaggatttcttatagaaattaatgagccgattctaaaattaatatggaaaaccaaaggaactagaaaagctaaaacaattttgaaaaagaataacaaagttggaagattcatactacctgatttcaacttagtttaaagctgcaataaccaagactgtggtattggagaaaagatagacatacagatcaattgaacaaaatagagaatttagtcacacaaaaattgtcaattcattttgaaaaagtttaagggcagttcaacagaggatagtctggaacagttgaatattcatatgcaaagaaaaaacaatctttgttttatttgggcaccaagtatccactgttggacactgggcagtcccttgcccaggaatttatgtgaatattgggacaagtgacatgaatccaccagtggatatgaaataaagtttaatcacacagtaaacagcaaaaggactcctcaaggtcaaggacttaggtttagtccaggatgaagcaagagtgaaacagggtgggtggctttggtttttattgaccagaaggtggaacttgtttgatggtccccatgtgtggtatttacatggtttcaacttcacaccagtaccaagggagggaatactggtccccaagtgtggtatttatatggtttcaactttacaccaataccaagggagggagtacctgggctttcttacagacttacccagatgtgggacaaaagggagagaggtgtgggacctgaaggcaatctgcactcaaacatcaaaatgaaatctttttattagagcctcaatctgtacttgacactgtatgcaaaaattagttcaaaatggttcgtaggccgggtctggtcgcacacgtttgtaatcccagcattttgggaggttgaggcaggaggattgcttgagcccaggagtttgagactagccttggcaagagtgagacccgtttctattttaaaaaatgttcatagattgtgaagtaaaatgtacagctataaaatatttgaaagaaaacataggacaaaaatatttttgaccatgggtcaggcagagatttcttggacatgatgccaagaacatgattcataaatgaacaaactgataaattagacttcatcaaaattaagaaattctgctcttccaaacacactgttgagagaataaaaagacttcacagactgggagaaaatattccccatcacatatctgacaaaaaatagactgtataaggaactcaaagctgggcatggtggctcacgtctgtaatcccagcactttgggaggccaagactggaggattgcttgaaaatccaggagtttgagaccagcttgggcaacatagcaagaccccatctctattaaaaaaagtaaacaacctaattaaaaagagcaaaagatttgagtagacactatgcaggaaggtgtatgaacagcagataaacaccccaaaaggtgttaaacataggccaggcatggtgggtcatgcctgtaatcccagcactttgggaagctgaggtgggtggaccatctgaggtcaggagttcaagactagcccggccaacatagcgaaaccgtctctactaaaaatacaaaattggtcaggtgtggtggcacgtgcctgtaatcccagctacctaggaggctgagacacgagaatcacttgaacccaggaggtggaggttgcagtgagacaagattgtgccactgcattccagcctgggcgacagagtgagactctgtctcaaaaaaaaaaaaaaaaaataaaggcattaaacatcattagtaattatggaattgcaaattaaacccataatgagatagtactatatgtctattgtgaaaattaagatattaagagaaactaaggaaaaaacggcaatacaaaatgctggtaagaatgggagcaatggaaactttcatcctttgctgttggaagggcaaatagtgtagctactttggagaaacgtttggcagttttttatgaaggtaaatatatacttgtcatatgacccaacattcccgctcctaggtatttacccaagtgaaatgagaacttaggttgatttcctcttttttttttttttttttttttttttgagatgcactctcactcttttacccaggctggagtgcagtgacacaatctcggctcactgcaacctccacctcctgggttcaagcaattctcctgcctcagcctcccaagtagctgggatttacaggcatgtgccaccacgcctggctaatttttgtatttttagtagagatggggtttcaccatgttggccaggttggtcttgaactcctgacctcaagtgatctgcctgcctcagcctcccaaagtgccgggattacaggcgtgagccaccgctcccagcctgttttctttttaatttttttaaaacagttttattgagtaataattcacgtaccatgcaattttccctttaaagtatacatttcagtggcttttaatatattcacagttgtgttaccacaacaatcaattttaaaacatttatatcactccaaaaagaaaccccagagccagtagcagtcactcccattgtcccttgcctaaccctgggcaaccactaatctactttttgtttctagagattattttacttaatgttttcaaggttcatttgtgttataacatatatcagtacttcatttctgtttatagccaaataatattccattgtacggatagaccacactttgtttacccactaatggatatttgggttatttccacccttttggctattatgaataatgctgctgccgtgaacattcatgcaaaagtttttgcctgggcatgtgttctcatttcttttgggtatagacctatgagtgaaatatctgggccatatggttattctgttcagcttttttgaggaactaaactgttttccagaccaactgcctcattttacgtttttaccagcaatgtatcagagttccagtttctctgtgtccttgtcaatacttgtaattgtgtgtcactttttgttttaaagagatgaagtcttactatgttgcccatgttggagtacagtggccattcacaggtgcaatcatagtgcagttatatgctcaaactcctagactccagtgatcctcctgcctcagtctcccaagtagatagaactacaggcgtatgccactgtacccagctagtcattttttactgtagccatcaaagtggcagtgaagtggtatctcattgtggaattgatttgcattttcatagtgatgaatgatgttgaacatcttttcatgtacttgcctctttggagaaatgtctattcaaatcctttgcccattaaaaaaaaatcactggccgggtgcggtgggtcactcctgtaatcccagcactttgggaggctgaggtgggcagatcacctgaggttgggagttcaagaccagcctgaccaacatggagaaactccgtctctgctaaaaatacaaaattagccaggcgtggtggcacatggctgtaatcccagctactcgggaggctgaggcaggagaatcgcttgaacccaggaggtggaggttgcagtgagctgagattgtgccattgcactccagcctgggcaacaagagcaaaactctgtctcaaaaaaaaaaaaaattattgagttctaagttctttatatatttggatactaaacctgatgctatcggaaatgtgattcgcaaatacttttttacattgtcttcgctttcttgaagcacagcagttttagattttggcaaagttcaatttatttatttctttggcttcttggtgctttaggcgtcatatctaagaaactattgcctaggcgttatgattaattgcctaatccaaggttatgaaaataatttttttttttaaatgagatggactcactctgtcacccaggctagagtgcagtggcacaatcatggcttatagtaccctctgcctcctgggttcaagcaatccttccacctcagcctcctgagttgctgggactataggagcatgccaccatgcccggctaatttttttatttttttgtaaagactgggtttcaccatgttgccaaggctggtctcgaactcttgagctcaagtgatccttccatcttggcctcccaaagtgctgggattgcaccttggtggcatgagccaccaagcctggccagtttattgtcttaaacttcaaaatggtcttaatgtgttaattttagggtaaatttacagttatcttgtttattcccaggtaattaagtgttgctgttgcaaatgagctttttaaaattgtttcctgtgattggttattctttgtatataacggtcattttctaaagagaatgccagtttttttccccaaatggtcatttttcaagtagtataactgctatataaaattcaatcttggtctgggcacggtggctcacatctgtaatcccagcacattgggaggctcaggcgggaagactgcttgagactagcctggaggtggagttggagactagcctgggcaacataaggagatcccaactctacaacaaataaaagaaatttaaaaaattggccggtcgtggtggcacaagccctgtagtccaagctactcaggaagctgaggtggaaggatcacttgagccctggaggtcgaggctgtagtcagctgtgattgctccactgcactccagactgggcaacaaagccagacccccaaacaatacaattagtcttgaatgaagtttcatgaaaacttctgaatttggaattgtttgccttacttaacttcataatttatatttaagtttaagaaatctaaagtgcatattgtacaaaacttttaaactttttacttgtatccttagggtggtgaaaaaaccaaagctgtcttatcagaacttcttgtttaaatcaaaaataggtgaaatttgtttgggaacaaaagggattgatggtggtattatgccagctagaagcagagctgtggaattcatcatttgggattttgctaactctatgatttatctatttacttaaactttgtttttttgttagcttgtttatttacagaaatagaatttttttaaattaaaaatgtttatcaaagaagtgtagatgttgagggaagagaaaaacaactgtgattccacctctcatttaacatttttttgagttcttttaattattgtattaaatttaaaaaacctgttacatatgtaggcaaatatattcttttttttgagaccaagttccactctgtcacttgaactttatgtagttcaggcattcagaactactagaactttgaatagccatttggttagggataagcatcatgctgtatggggatgaattaaaggtagaatagagtgccagaaaaaggtaaaaggggtcagtttcttgaagaaagagaaaaggggtggaggaggtgtcataagcaaaacataagtgtgtgtttttgaaatgatctcatcttaacgttctttctgacaggaaagacttaggactttggaagaacttccaaaagacagcctgtgtagcactttcagttaagggcaatatcttaacttagagctgacttctaatatgaatcttgaaatgcttttcatttggaattatgccaataagtgctacaatactgctcagtacagttcactaccctagtacagaaagtgagggaaagaagctagcgtgatttctgaatttgtgatagaaaagttggtcatagcattaaagtatttgtccatcagattgtaagtactagacatgtagctcactcttcttttaagaacagaagtatgactggaattcatggagttaagtaaaaacaatggcaatttgcagagggattatagggaagaacagaaatataactaattctattagtaattactcttacttgtcttggaagatacatcctgttaagatggaaaagacatgccaagttttgacataatctgagattagtctttcttttaaaggagattgcatccattttgacccattaatttctttttcaagcttgtttgaatatttagaacaggaggcatttatattttataatttttgataaagtcataatgtcttttgggatacttgactcttaaatgttctataatgattctctttgcaagctgctttctgaatgaaggtagaataaatagaagtgagacaccataagcacattataatggcctgatttaggagcctgaatttgtggtgttcttttgtgttgaccatgaaaactgtcagaaacattaaaagtctgaaacagatttcaggaggaccaacagttgaataagggatctgtatgaggaaaaataaagttggagccttctaaaagaaggtttggaacaagtgtcgaaggttaaaagaacccctgtggaaaattttaagtgtcagagaaagtttagtttagaatatcaagcattcttggctggaccaagtgcaatggtgtttacaactaattgatcacaatgagttacaggtttctttgttttttctgcactcccattgctttacttgactagcttaaaaaaagagaatatcaagcactctttagtctgccttattaatttttgaatgatttgtctgggagatataaacttttgaaaattttacaactttttcttggaagaaaaatatttgaccaaaacgctaatagaattatttaccagatgccctgtcctagtaattcactggataacttgtacttaaaattcaatgactcctcataactcaatgtaaatatagatgctccttgacttatggggctgtgtcctgataaaccaactgtaagttgaaaatactgtaagatgaacatcatagcttagcctagcacaccttaaacatgctcaaaacagaacacttaaattagcctacagttgggcaaaatcatctaacaaagcctattttataataaagtgttgaatagctcatgtaatttattgaatattgtaccgaaagtgaaccacagaatggttgtggggtcaaagtatgttttgtttttgttttgagacggagtctcgctctgttgcccaggctagagtgtggtggtgccatcttggctcactgtaaactccacctcccaggttcaggcgattcttctgcctcagcctcctgagttactggaattggaggcacacgctaccacgcccatagtagagacagggtttcaccctgtttgtcaggctggtctcgaactcctgacctcgtgatccgccagcctccgcctcccaaagtgctgggattacaggcgtgagccactgtgcctggcccaaagtatgttttttattgaatggcatatcacttttgcaccatcataaagttgaaaaatcctaagtcaaactgtcctatgttggggatcatttgtatttactatatggtagaacttttaagatctgttcccaggtttgattgacctgttgagtctgtgggactggacttccctggaataagaactgtaggaaagttttgtgtttggatgaatgtaaacttcacatttatttttatccaggcctacctgaaaatgttttctggtaggatttcttccatactgctttttttcttatagtttaaaaaatgtaatatgctaccaaacattataagtaatatacatgtatgttacaaaaattatataataaacacttttgaacctatctaaccaataacctaaatattatcaataacttattcatactgttgcaacaccaagttttattccagtgtaagtttatctttggatctttgactcttcttgggttttcttttctttcttcctcctattcctcctccctccctcctctttgtctttttaaaaattaagacaagtcttttcagggatgctatctgagattagtctttcttttaaaggagattgcatccattttgacccattaatttctttttcaagcttgtttgaatatttagaacaggaggcatttatattttataatttttgataaagtcataatgtcttttgggatacttgactcttaaatgttctataatgattctctttgcaagctgctttctgaatgaaggtagaataaatagaagtgagacaccataaggaaaccattgtttgttttgtttttgtttttgagatggagtctcgctctgttgcccaggctggagtgcagtggcgcaatctcagctcactgcaacctccacctcccgggttcaagtgattctcctgcctcagcctcccgagtagctgggactacaggtgtgtgccaacatgcctggctaattttttgtatttttagtagagacggggtttcactgtgttagccaggctggtctcaaactcctgacctcaagcaatctgcctgcccgcttctgcctcccaaagtactgggattacaggtgtgagccaccatgcccggctagaaaccattgttaaaaaaacctgtgattgatacgtttggctattaacatgtcacttaaagtttctgaatgaatgtggatgaatgagacatagtgctaaaacagattagagaaccattctctagagtaattagacattcagttgtacttttacataagataaattgaagtaaaatctattttaaatgcagaggtgatttcatagggttgtttgctgtatccagtggttctcagactgtgatcccccagccagcactatcagcattgcctggaaacttgtgcaaattatctcgacttttcagacctttaggtgattctgatagagctaaagtttgagaagcactgccatataggtctatcttcatttttattatctagcttgggtaggcatgttagtttggaataatgttgtatgggtctgaacttcctattgtaagtgacagaaatccaacttgaattagcttaagcaaaaaggaatttaaaggctttcttaggtgggctgggagattattgtagtagcttacagattcaaagcaatagttgcaaagaatcagggccctgggggttgaaactgtttgtctctgtatgactttgtcctgtttatagatcctagacaagtgagaaagatggtcacaggagagccccaagttcacatcctctgagcttagcaactccagaaagagctgctttctaccattcacaaggccatccctcaaccgttatgttaatgagaatgaaagtcaatgattgacctagtctgggtcttatatctaagtgtaggaggaaatagaatgggaaagtgtgctactttggcagcctagttcactgctagataatagggttgctttcaaagtatcgttatttttatttttattgttatttatttatttatttattttgagacaaagtctcactcttgtctcccaggctggagtgcaatggcgagatctcagcccacaggaacctccgcctcctgggttcaagcgattctcctgccccagcctcctgagtagctgggattataggcgcctgccaccacgcccggctaatttttgtatttttggtagagacggggtttcaccatgttggccaggctggtttcgaactcctcacctcaggtgatccatccaccttggcctcccaaagtgctgggattacaggcgtgagccaccgctcctggccttactgttgtttttacgggtatagagtctctgtcacccaggctagagtgcggtagcacattcatggcccgctgcagcctctacctcccaggctcaagtgatcttccagcctcaacctactgagtagctgggactactaccacacctggctatttttaaaaattttttatagagttggggtctccttgtgttgcctgggctggtttcgaactcctggcctacagtgatcctcccaccttagcctcccaaagtgttgggattataggcatgagccactgcacccagtttaggcttaagtatctttgaaaaagagaaagtgaaatgtagaggcttatagaactacaagatggaacatgctcaaaaccttatattatttgttagctactcttttgttagagagtaattaactacttctttaaaagtttagggtatcttaatatgagagttaatgctttaggtttattattttgtacgaagttaatttttttgtcactataaaaatatattataggaggtctggaaaatacagagatataaaagaaaattaccagccgggcgcggtggctcacgcctgtaatcccagcactttaggaggccgaggcaggcagatcacctgaggtcaggagtttgagaccagcctggccaatgtggcaaaaccccgtctctactaaaaatacaaaaattagctgggcgtgttggcaggtgcctataatcccagctacttgggaggctgaagcaggagaatcgcttgaacccgggaggcggaggttgcagtgagctgagattgcgctactacactccagcctgggcaacagaatgagactctgtctccaaaaaaaaaaaaaaaaaaaaaaaaaaaattacctactgctttgctaaccagagacaattacactttggtgaatttcctctgcatatgttcttgcatagttatgactgtattatgatgttaatttttcttcgttttgaccagtgttaatttatttataactttgtgttggggtaatgaaaacataatcttagtcaatatagattccaccaaggttgtatgataatttttaaatcttgttttttcatttaactctacaagttaaaggatgtgttcattttaagtttcttggcatataacaacattaaataattttgcttgttaattgttcacttgatgggcaaaaatggtttcttattttgtgtcattaattactaataagtttgagcattttttgttgagctaactacttttcctttttgtgagttccaagttctatatctacttgtctattaacatcttagtggttttcttattgatttgtatgaactccttaaaagtgctctattttctttaaatggttttctagtttgagttttaaaggtttttttttttttttttttgacacataagcttattttgtgtattcagattccatctggcttttgataggttgttttctttctctcttttttttttttttgagatggggtctcactttattgcccagactggagagcagtgacaagatcatggctcactgtagcctcaacttcctggtctcaagtgatcctcctacgttagcctcccaagtagctgggaccacaggtgtatgccaccgtacccagctaattttttgattttttttttttttgtagagatgaagtcttgctatgttgcccggcctggtctcaaactcctgagctcaagtgatcctctttccttggcctcccaaagtactgggattacaggtgtgaaccactgtgcccaggcattttcttatttttaagtttagaaattctctgcttttagagatctgataactattctgttgttgctatttgttttactttgttttgttgattataactatttaatccatcctagaattcattttgaaacattatgtaaggtaaagatatttattctttttacgattgttttgaatttttatgtaggctctgtcattcttaaaatattttcaagctattcgaagaaaaataccatcttaagctgctttttagttatttctgtaggctaatggtttttaattccttgtgagatttaaggacaatgaaagatgacaaaaaaactttagtgacaatatattttagcaatggcaaaataacctcttttctgacaaatctaaactctcttatcagagttaaaagtttagacaacatttgtgattagccttctgttaacagtgaaaacatttgtattttctgcaaatagcatttatccatgaagaaaattagaatagaagtatgtttaaacagaaaattctagactcttcttcagacagctcaggcttttcaaaaagccttgtgctttggcaggagcccaggagaggaagtgtctacatctgctacattctagaagccttccccaaatcactgtaaggtagccaaaagagcagtgtatttccttactgtgtggttctggaagtaactggaagtttgcagcaaactcgagggaggagactagggagtacttccagtttttgtggtgatctgtttttattgagattcaagttagggggcagtggggttattttttagctcttgtagaacggggagctttcaatttgaacctgagccttttggtttagctcacgtcacataggaagacgagtcagaggggcctgcacaaagagaaacaggttgacaagtcagggtaactaatgggagcctgttactggggcaaactatactgtaatgtaacttattctcctgtaaggtaataagaaagacaaagttcatgtttgtaggggagaaggagcaagagaagagtgctagcagggcatctgggaaagtgaggtaaagcctttctgttggttagtttatatcctcatctgccatgaagaatcctcactagaaaagacggtgctatcatggatatagaggaaaaacactaatgggctttgctgccaggtttaaaaaaagaaaagaggccatagacatgtcttaggctaagtttttttttacatagaacacagttgataagagaaacaaaactgaagtctgggtcctttgagagaaaatactagtttaaatggacatggctgtttattcgttttggattctctacaacttaaaaaaaaaaaaaaaacaggcacagtggtacagacctgtatttccagctactcaggaggctgaggtgggaggatgatttgagcccaggagtttgagttcaacttggacaacataacaagacccctgtctcttaaaaaaacaaactaagtcaaaccaagagaacagtgtcattgcaatataattcatataccttataattcacccatttagtattcatgattcaatggtttttagtactttcacagagtcattccaccatcagtcaccacagtcaattttattttatttattcatgttttttagagatggggtcttgctgtattgcccaagctggctttgaactcctgggttcaagtgatcctcctgcctcagcctcccaagtagctgggactccaggcacctgccactgtgcctggccagtcaattttagaacattttattgaccccaaatctacaacttttgattgaatttattttaaaaagttaagctatataggaaaaagatgggccgggtgccgtggctcacgcctgtaaccctagaactttgggaggatgaggtgggcggatcacctgaggtcaggagttttgagactgtcacacacacacatacacacatacacacacacacacacactatatatatatataaaatatatatgaaaaagatggaacaaattaggaattttaaggattaacagaaagctctgaaatatttttcctttaaaatgtattctaacattttgaaaatgtattggtaatatttaatatttaaattgataagttggtacatttttatgagaaagtcataggataggtctaaatcacagagaaaacttatttttcaggctatatgaaaaagccacctactattcaattactctaattgtaatagtgactaaggagaacaaactcagcttgaatttttaagcataaattatcaggtgataacaaacatacatttttatctaatatgggtgcgttggctcacacttataatcccagcactttgggaggctgaggcgggtggataacttgaggccaggagttcgagaccagcctggccaacatagcaaaaccttgtctctgctaaaaagacaaaaagttagctgggtgtggtggcacacacctttggtcccaactacttaggaggctgaggcatgagaatcgcttgaacccgggaggtggaggttgccgtgagccaagatcacaccatggcactccagcctgggcgacagagactctgtttcaaaagagaaaaacacaaaaaagaaatgtcatggtagtactctcattatatgaaaaacaagatagtagctattattaaacaattgataataactaacatcaattttatgggcaaccttggaatcttttactttttcatagaaataatagataaggaacttttccttctctttgtattttttaagtaatggctgcatttctctctttcttttgtaggtgtgtgatcctgtaaaattaaatcttccaagatgatctggtatatattaattataggaattctgcttccccagtctttggctcatccaggcttttttacttcaattggtaagtcttactacttgttgttttttgttggttttgcattttttaatttccattttttagtgttttaaaatcagcaaaaacaaatacagtgtattcctagagtataggtttattccctgccccctaaaaggtccttttttaataatttgacattttctttattttttattacaaaaatgatacatattgaagttaaaataatttaatgcatatacttagtctttttcagtgcacagatatacaagtaatatactgcatatatatctaatctgctttttccacttaatctactgtgaacacaagtttttttttgtatttataacttaaaaaatattttatcattattattttgaatagagacagggtctcaccatgttgaccaggctggtcttcaactcctggcctcaagggattctcctggctgggcctccaaagtgctgggattacgacaggcatgagctgccacgcctggcccataagtattatatacttatgactcttgattccagtatataaaatgatgggttctcgcatcctgttataaataacagattatttgaaacttttttagtgtggcttttattaattaaataaaaatttaattctaattagtctcaaaaacaaaggtaaggtaaaggggaactaaagaagtaaaggtaaaggtgaagaaacattaatctttggaaagtagtgttgatttgcaatttaaaaatacatttgtagatataaagacaatttgctagcacagtctaaagcttgcaaaatcaagtggcttaaaaattagaactggaacagttgattagaaaagtttttggctttattttggtttatctggtaaaaaggaagaaaagatagtctccagcatatctgattcatgccagttaaattgtctcatagaatgaaacagtctcaatcattcttattcttaacatacttgtgttgaaggatatgagtatttgataaccttcttccccttctaggtcagatgactgatttgatccatactgagaaagatctggtgacttctctgaaagattatattaaggcagaagaggacaagttagaacaaataaaaaagtaagcaaaatgtttgcttattatgactctgactcaacctggatgttttctttctcaagctaaaatattctttaagtagaaatgaaacccatttttgagtcttacaaagccagttgcaatggctaaaataggagtatagagaacaagttaggcttgggccaactttcacatggaagaatatgggttgggataagaatatggatagataccagccggatgcggtggctcatgcctgtaatcccagcactttgggaggccgaggagggtggatcacttgaggccaggagttcaagaccagcctggccaatgtggtgaaaccctgtctctactaaaaacacaaaactagtcgggtgtggtagcatgtgcctgtaatcccagctgcttgggaggctaaggtgggagaatcacttgaacccgggaggtggaggctgcagtgagccaagattgtgccactgcactccagcctaggctacagagccagactctatctcaaaaaaaaaaaaaaaaaaagaatatggatggatacaggaagctgactgatacatttttttttttttttttgtgacagagtcttgctctgttgcccaggctggagtgcagtggcatgatcgtggctcactgcaacctccaccttccaggttcaagtgattctcttgcctcagcctcccaagtagctgggattacaggtgtgcgccaccatgcccgggtaatttttgtatttttagtagagacggggttttgccatgttggccaggctggtctcgaactcctgacctcaggtgatctgccctcctcagcctcccagagtgctgggattacaggcgtgagccaccgcacccagcctgactgataaattttaaaagtattgctaatatcttctatcctcttctaacctcttagtcaagccacctgctgcagcaattttccaattctacttatcctttactcccatggttccattgtagagattatagtgatggtagcgttagtgttatttaattgatacagtttttctcaaatatgaatttatttttaattgactcatgttcatagttaatcctgacctgagaattcctgtcttttatttaatgagtagctaagtgttcagtttttcattttaagatacagtttctagaaactggatgtaaaaatttagtataagttgatttaaatgaacatgtaattgaatttgggttgggctaatttgtagtttgtaataatcagttatttggccctgggacctaagtctaaaatttttagacttttactggagggattcattcacaacttttactaagacagggaggttccatttactgtaaccatttgggagaaacaaaattaaaacaaaaagtcctatagttgtattgattctgccaagaggatgtcgctttttaaagagaccgagaccgtatacttttactttaaaaagaaactacagatatagttgaactcaaaaacttctagtcattttttttctgagcgtttcattaaattgtgtttttccctatgaaatataaatattcagtttttatgttttacatctgtagatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggtaagtctgaagagattcctgagtaaggtaatattgccaccatatgtagaaataataaaattaatgataaattcagttcccaggaaaccagttcagttcagtgttgtaactggattatgcctgggtgcatttggtttgaatagagttaatttagtcaaaatcctgaattctttgattaaaaaagaagtaatttctttttttgttgacttgttttgaaatctgcaaaagtgaatagattatttggcatatagcttcatttctgagggtaatcatttttattttaggattaccttcaaactttaaaaatttatgtctttatctgcaatcaatttaaaaaaatgttgggagtgttactataaagagaagtattagctgtgttctatctagtattttgaagtttagaattagtttgctcaatgtggacaatcaaactgaggctgcaaacagtaaaaatgagtaagtgatacaatacaatttgtagttggagcattgaaatgttttagatactttaataacagatgtagaagactaaatctggactttattaaggaggtaaagggattatgcctcgccccccgccgcccctgccctgccccgccaagaaaagaagaagagagagacggaaaagagctgagctagttgtgtagataaaatactccaagggtacttaccagtgtttgtaagcagtgaagtaaacttattatgcacagggatcaggaagccttgaaaagaaaaatatggcaagtacttgtgaatacttctttactgtgagagggaaatgcctgtgattattttctgtactgtataacaccttgggaacttttttttttttttttggagacagggtctcactgtctaactgttgcccaggctggagtacagtggcacaatggtggctcactgcagctttgaactcctgggctcaagcaatcctcccacctcagcctcctcagtagctagcactacaagcatagaccaccacgccaggccaatttaaaaatttttctttcttagaaacaaggtcttgctatgttgcccaggctgatctcaaattcttggcctcatgtgatccttccacctcagcctcccacagcgctagggattacacgcgtgagccatggttcctggcccctgaaccattttttaaaggaaatcgatatatttattctcaagtaatgaactaagttgttttataatgtgaaccttggcactttgttgttttaatctgtagtagtcattctataatgctatgagagagtatatatattttaatttttcttagaattttgtttgtagcataagagatattatagccttctataaaacttataaaacttgcttgtaaaattccatatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttcacgcctgtaatcctagtagtttgggaggctgaggctggcagatcacttgaggtcaggagttcgagaggagcttagtcaacatggtgaaaacccgtctctactaaaaatataaaagttagccgggcctggtggtgggcacctttaatcccagctagtcgggaggctgaggcaggagaattgcttgaaccgggagttggaggttgccatgagccaagattgcactgctgcattccagcctgggtgacagagcgagactccatctcaaaaaaaaaaaaaaaaaaaaaaaaaaaaaaaaaggcctggtctcttgctgttcaaaatacgtagctggctggacacagttgctcatgcctgtaatcccagcactttgggagaccaaggcaggtggatcgtttgagaccaggagttggagaccagcctgggcaacacggtgaaaccccgtctctactagaaatacaaaaattagccaggtgtggtggcacatgcctgtaatcccagctactgggaggctgaggcaagataattgcttgaacctgggaggtggaggttgcagtaagctgagatcatgccactgccactgctctccagcctggatgacagagtgagactgtctcaaaaaaaaaaaaacaaaacagttgattataagttaatgagaagagagggaagtctcatacctaacttttattcacaagtaatgatactgatattaaaattttaaaccaattttttatttcttaaggagtgtttagcattcattcttcttggggttatatagttatcagtaattggtttgtttgatttttgcatactttatataaatcctctaagattaggtttatatattgtaaattttggttgatcaacgtcatgtttgataattaaactgatttaaatatattttagtaaactagctttgctgttgatcttaaatatatagttaatatctcttccttctccttgaagaattccaccaaactttatatatttacatatttatataatgtgtaatacatggaagaaaaaaacaactttaagagcacatattttacttaccatctgttatctggaagtataattgattgtcaatgaatgtcatttcagacccataaatgtgttcatttctcaaacttagtggatgcactttgttttcttgctgtgttatataactaaaaactcataactattatgttaggtgatctttacctgctaatacagatacaatttatataacagcgtcacagtccttaagcaacactaggcttttggaagattgaacaagttagaagtatgccaagtcttattcagtgtatttaattttttcttgttgagtatgtagaacttttcatggtgtggtagaaaataataaaatagattttgaacaatccttattaagtctctttatgggaagtttatgaggttctacagtttttttttctttgatttatctatttcaaggctttatctctaacctaaccattcagagacagtactttcctaatgatgaagatcaggttggggcagccaaagctctgttacgtctccaggatacctacaatttggatacagataccatctcaaagggtaatcttccaggtaagatcattcttccattctataaaatacctatcacctagcttctctgttgagtccattaacacaatgttagtataaaaaagacttgcattttaagattttaaattgtagtttgtttcatagccttcgaagactaaagaatcaccttccctttctcttagggcttaatagttacgggtatgcttctagcttctagcttgttactctgaaagcttgtattgatagagactaacttaagtagggaattttagtgtgtaaggaaaagaaactatcatttcaccaaatgtttttattcagaacacctaatactatttgaaagctttgtatgtaaagctataagggattgatagtcaaagtttatatgttaaataattaaaagccaagatgttttgggtatccacatatgtttaaagtgttccatagtatggaacatcctactttctgacctatttttggcaaagtcctctttttaagttacagttgctttcatgataatttacttttgccgtccctcactttttcaaagtttgtgactcattaccactactatctcctgttattgtcagctgcagaaataaaatatgttgtctgtgtcttcacattgaaattgattttctccgtaagaaaaaatcactgggatgagttgttaatcaaaatgttttcttgctcatctccctttatttgaggtgaaggtatccgttggtaaaaactaaacatggtataatagtaaataaaatttctgttaagctggaatataattccattaatttgaacttccaaaaatgtacaaatttgcaaattttcagtttctactaatattatacattataacgcttttgataagattataaccttatttttaaaattggtttcaggttttcatagatattaaatacttaatatgtgccagctattatgttaggtactggggacacataatgaacaagacatacactaccctcgccattagggtatttaacattcttacagtatagtaagatgagtgcttggatgggagaaattcaggataccatatgagcacatcaaaagaaacctattgctggacctcataagggatgtaaaggaagaattcctggaagatacacattaaaaaaattgagatctaatggaccaggaattagccagaaaaatgggggagagggagacaggagtgggtgtgggaaaagtgtttcagacagagggaacatgtagaaaggtcaaaaggagagagcatatcatattcagataactaacatgtagtttgtatggcttaatgtagagttcaagaggtgaacgcaccaggtggatatgggggtttggctttgtgagagtagtgagagctgagactagagaggtaagcagaagccatctcttggagagctttgtaagccatgtggaagagattgaactgtcctgagtgcagtgcggagctattaaaaagtttgtaagggaaatttatgatttttccttttagaaaaccattctggctgccgaatggagattgggttggggccaagggacgaagaaccagggaggaggctgttgcaaatatttaagtaagaggtggtagtggatagattatcaagctacttattagagtagaatagtagaatttgatgatgtacttgataggaatttctggcttcatcaactggatagattccatttaacaaaatagggctggcatggtggctcatgcctgtaatcccagcactttgggaggctaaggtggaaaggatcccttgagggtaggagttcaagaccagcctgggcagcatagcaattccctgactctacaaaaaaatgaaaacttagctgggtgttgtggtgcttgcttgtagtcctagctatttgggaggctgaggtgggatgtattcacactgctatgaagaaatacccaagactgggtaagttattttaaaaaagaggtttaattgactcacagttccgcatggctacggatgtcttaggaaactcacaatcatggcagaaggcacttcttcacagggtggcaggaaagagaatgagggccagcaggggaaatgccaggtgcttataaaaccatcctatctcatgagaactcactgtcacaagaacagcatgggggaactgcccccatgatgcagttatctccaccttgtcccgcccttgataggtggggattattaaaattcaaggtgatatttgggtgtgaacacagagccaaaccatatcacgggaggatcacttgagcccaggagttcaaggctgcagtgagctgtgatcacgccactacactccaacctgggcaacagagtgagacccctatctcaaaaaacaaaaagcaaaaaagaaaacatcccacctcagcctcccaaatgtgtggtggtgggtaataaatgttatttagattactatatgtgttttgtttaaaaaatgattatattcccatcaaaatggtcctgaatattatttaaccctgatttcactgtgtttagtcttaggggcaatattcattctttctcaggtgctttttatctccttgttgacttttttcctcttttatcacagttttgggctagttcttattgacttttctttcaggcaaattccttataagtagaataactgaaatttcctaatcacattataccctataagtggtaaaaataatagcatgaatactagcataagagtttttaggctcccccaacccagattattttctgttgttaatagtcaaatatcacaaatgtgttcgaaggcttcttgtgcaccttcccttgtttagaggtaatgactattctgaacttggtgcgtatcctgtcatctttttatactttatcatatatattttccattgtattgtgtttttaaattttatgtcaatagtacatcatactctatgtatctttctacaacctttttttaacctaatattttcagtaaatttatctgtgttgatcagattcatctaactgctaatgtggtattgtataacattatttattcattcttctgtggatggatgtacatttagattttgtccaattttttgctttatcaaatgaagtttgatacatctttgttgatttctttttgtggccatgtactcacgtgcaaggctttctcttagggtataagaaatcatagggtatttggtttttcatcatacttaccagatgtggccagattgctttccagagcatgtatttatactgtcaccagcattgtatgagagttcccatttcttcatatccttgccagctcttggttttgtcagactttaaaaattttagcaatctgggtgtgaaatggtgggggtgagggaggaaggatgcatgtattttaaattttcttcaaacaaaaaagtcagagaaatgcttagtgaatttatattgatgccacatcactccttgattagtttcatctgtttcttttgcctctttgggcctatcttttgaaatgctttgttggtattttaatgaaaaatctgataggttacatgcattttgacatcagtgttgtccttatagttcttaaggacttccttcagttttcagattgtttgttcccaaccctgatttgttgaatagatccatatctgccaaagatatcatgcttttttttaagctgtgattttttttagggggtgggggtcagtaatagaaaatgtcatatgtacaaaattcaatttgcttcatgtggaagttgaatgttcacccttctggtcacttgcatcactgtcttggtaagttaataaggtaactatagcaaacagtagattctccagacatctctggagctcactcagctatcagtgtaccacactgcctcagaggtgggacattaacttctaagtgtgtgcattttaaacataattatcccttacaaattaagttttgatccattaagtgttcttgtgaagtgcaagaatttttggattacgtgtctctctcagtttaacggatgatgtctctctcagtttaacggatgaaccataaaaatcgatttctttttcttttttgacatggagtctcactctgttacccaggctggagtgcagtggcgcagctcggctcactgcaacctctgcctcctgggttcaagcgattctcttgcctcagcctcccaagtagctgggattacaggtgcccaccaccatgtccagctaattttgttatttttagtagagatgaggtttcaccgtgtcagccaggctggttttcagctcttgacctcaagtgttccgtccacctcagcctcccgaactgctggaattaaaggcatgagccactatgtctagctaaaaatgtatttctaaataatgtttttcctatagtgcctatgatattatagtttattttctttattttctttatttttttgagacaggatctcactctgctatcaacccaggctggagtgcagtggcacaatcacagctcactacagcctcaacctcccaagctaaggtgatcctcctacctcagtctcccaagtagccaggactacaggcatgtgccaccacaagcagctaatttttgtattttttgtagagacagggttttgccatgttatccaggctggtttcgaactcctgagctcaagcaatccacccccccgcaccccgcagcctcccaaagtggtggggttacaggcaagagccactgtacctggcctgatattatagtttctattgtgacaataaattaaaagactctttagtgttagtttactttcaatttggtttattatattcaatttggtatgttcatgtcagtcatccatgcctcttcctttgaaccaaaggaatttacaacttattcttgtttctcatcaaactcggtttgctttttatatgaagctttttacagtctttttctgcccataccactttccttatttcattttcttctttgttttcttgcctactttttcttctcatgttctctactttggaaacagccttccttttcaaatgctgcattacttttgatttattttaaaatcagattcccaggcagtctgcctttaatattgttaatagatcagtaagtaagacaagcagaaatactttaccaaagcagaatagctaaaaatcttctactatctctgccatgcatgttcaaataatgttgccagaatatcaagtcatgtaaaaaaaattattggtgctatctgcgtggattaatggcatactgtcatcttatgtgttttgcatgtccctaagagaaacatttataattgctgcattatgagctcatcttctcagtttactagttctcgtaaccgaaaaaataatagcattgtcaaaatttaatatgcatctttagtttctggaactaactcatgttaaactattaagaagttagtttcttagcatctgctgttgttggactatgtccatccaaaatttaggtggtgaaacttcatggccagtgtgatggtattaagaggtggggcctacaggaatgggatttaaggcccttatgaaagaggctttatgcagccactagctctcttgcccttcagccttcaccatgtgaggacatagcattcttcccctctggaggatgcagcaacaaggtgccatcttggaagtggagagcagccctcactagacaattgaacccgctggtgctttgaatcttggactacccagcctctagaactgtgagaaaataaatttgtttttttataaattatccagtccttggtattttgttatgggagcataaatgcactaagatagtatcctttcctagagtggaaggcgggatagagaattatttaagggaaaaacatcaaaacgtgggtcttcatcttcattttaggagtatactgataatcagttactgcctgtaagtgactaatggggccagaaaaaaaaagtgaatggagatgattgtatgatttgaatatttgattatattgggtcatgtgatcctccagtgcatacacctccaagcttggactctgtttgatactggaattcaacagctcattgtcagaccagggcatgcttttctgtagtctgcaaatgtctgatcactagcaaaacgtgcccataactttacttccttttgatttatttctcataaatgccttttctgttagcatctttttaaaaacatatgtgaccaccattggataggttatagctaagtccggttctgggcattttagtgactctttgaagtgtattcaatcaaaatttattaaagaaaccactgttgtgtttgtttctctaccagttttctttgtgatgttatcggacacttaataaatatatacagttttatgtgttttatcagagaaaatgtaggctagtctgtctttgaccagtagtttctggtcaaatacaatattatactagtataatattgacttagtctcagaactgtatattctgagagaaatgttgttggagaagtcatattttcttgtgtaggcttgttgttgttttttcacatacctgtcattttttttttatagtgtcagaaagggaactatgtgattttctgtgtaacagcataaaaagagccctgtaggacatgactttctcctttttccattatttataaaatttcttttattatggaaaatatcaaatgtcacacatacacaaaaataaaggtaataacataatgaacctatgccatcaccaagctccagacgttttaaacattttgtcattcttggtttatctactccttccaccctttctttctgtcatttttgttggagtattttaagagcaaatcctagacatcatgtcattttatccataaataattcaacatgcatatctaactgatcaggtctttattaaaatttatttttttgaggcaagatttcactctatcagccaggctggagtgcattggcatgatcatagctcactgcagccttgaacttttggactcaagccatcctgctgccttagcctcctgaacagctgggactataggtgcgtgccaccacacctggctgatttttaaattttttgcagagatgtgctattgctgtgttgcccagtctggtcttgaattcctggcctcaagtaggtctttgtaatttatttttaatttttttttagagacagggtctcactttattgctcaggctagagtgcagtggtaccattatagctcactgcagccttgaactcttgggctcaagtgttcctcctgccttagcctcccaagtagctgggactataggtataagtcacctgcgcccagctggtctttttaaaaaagtaacataaccacttactatctccctgcttaacaaatcgacagtatttccttaatataatttaatacccagtcaatattatttctctggtgatctcaaagttgttgttttacagttgtatttttttaaattatgtctgttaagtcccttttattcccttttccttttttttctttctctttatgacattggttagctggggaaacctagtcatatgttatgtggaatgttccacattctggagttgactactttggtggttaacatgttcctttaatgcctatgtttcctacacactggttagagcttgtggcttgattagattcgagttaaattttaaaattaactccataggtggcgctatgaactttcttttgaactgcgtgaaccaacacctaatgtcctgtcccactttttatgatgctgattgatgagtgaggttcaggtgatgagagcctgatccctccatataaagttctccttaagttttatctactggttttggcagcctttgatgatcattgcctagaaccactatttcattaggggttacaaaatgatgatttttttcattccattattccttttacttttattaactggaattctataaacaggaacatccttcatgaaccatttggttaccctgaactatatataggaaaggcagggtaagtctataattagtcttctttatcagttttcagagtaatgagttggtgtcctaaccatttttagtagtgatctgtaattttcatgacatatcatgaatatggatattattattttttttttgtatttcagcctattcagtattactttgatctcagattatcccattttaggccagtggggagcatctttagataggcttgtttttttgaattgactgtgttattattctttgatagagaggaaacttccttgctttctggcacagttttttttccaggtttctattccagagtaggaactaggcatttcttcaatgagccttggcccttctttttccccccttaagagataggttcttgccatgttgctcaggctggagtgcagtggctattcacagatgcgatcatggtgcactacagcctggaactcctgggctcaagtgatcttcctgcttcagccttctgagtagctgggactacaggttttccactccttgcctggcaaggcttgattgctttgaacagggatgacatttaagcagcagagtctagctaggttctaggggtgattattgctatatagtttgtcataaacagagacaggaaatatgtaagttcatattgttcaaattgaaaaccacagggtttatatttatatctcttttcttctgaaaatttggttcctaaggatattaacatgattattcttttattcatactattaactcatactattttattcatactattaataacattaagactactgaatacaggtttttttgtactttatatccttaaaatatatcactctagatatgatcagtcaaaatcttgttttaaagacatctgaggtaattcatttctctttgtggctatgcccttaacatgttatacagttgagttcatttatttcatttcctcagatttttagggattgtcctcgttttttcttttgattcattgttttcatttgtttgttttagaaacaatatcttgttctgttgcccggcctggagtgcagtggcatgatcatagctcagtgcagccttgaactcctgggctcaagggatcctcctgtcacagcctcccaaatagttaggcctacaggcatgcaagtaccaccatacctggctatttttttttattttttattttatttatttttattttattattatttttttcagatggagtcttgctctgtcgcccaggctggagtgcagtggcgtgatctcagctcactgcaagctctgcctcccgggttcacgccattctcctgtctcagcctcctgagtagctggcactataggcgcccgccaccatgcccggctaattttttgtatttttagtagagatggggtttcaccatgttagccaggttggtctcgatctcctgacctcatgatccacctgccttggcctcccaaagtgctgggattacaggcgtgagccactgcgcccagcctttttttttttttttttttttttttttttttttttttaaatatattgtctcattattttgcccggggttgtcttgaactccctggctcaggagatcttcctgccttggcctcccgaagtgtcaggattacaggctctagccgccatgcccagccaatttattgtttttaattatgtaaaacttttaaattctttgacagtccaaactagactaataaggtacattaatagaagtctcactttcattcttatacttttcaacctattcccttcctttttctatgtgaccattttgttagttttactatttccagttttttaaaatacaagcaaatatatatctactcctatattctctcaacataaacacaaaagatagcgtactggctgggcgtggtggctcacacctgtaatcccagcactctgagaggccaaggtgggtggatcacctgaggtcaggagtttgagaccagcctggccaatatggtgaaacaccatccctactaaaaatacaaaaattagctgagcgtggtggtgggcacctgtaatcccagctactcaggagggtgaggcacgagaatttcttgaacccggcggggcacggaggttgcagtgagccatcgcaccactgcatttttagcctgggcaacagagtgagacttcgtctcaaaaaaaaaaaaaaaaaaaagcatactataaatactgttatgtactttggtgctttaatttattgatataccccagtcattacttcatgtatagaaatcctcatttctttttatagctacgtgttattactctattttgtggaggttctacagttttttttacttattgtcagtagaggatgatttattgggaaacttagagatggaagcatggtcttgggcagtagcaagacaggtagatctctgcaccgttagtccccagacccatgacttaagtgtcatagggaaaggatgtacatgctctgtagggacaaaggcaagctccagaacaggcaagaatgctatgcgtgtcatagcctgtaatttttgtgataacatcaaggttgctttgctctaaaggcaggatttatagtgggtacatgttcctacactaaggacagcaagtaaagtagaaatcagcaggcattcgtgggactgaggttaatcaaaagtgaacatggtagattagcatgcaagatggagtcactgttgtcttcacacccatcagtttctacttttttcatcccatttcttaataaccatctaaagattgccaccctgctagagcgcgtcccatgaccatcccctttcttttttcccttagtttcacccctatcaatgttgtctttattcacctttttttttttttttttttttttttttttctggacggagtcttgctctgtcacccagactggagtgcagtggtgcaatcttggcccactgcaacctcgcttcccgggttcaagcgattctcgtgcctcagcctccccagtagttggaattacaggcgtgtgctaccatgcccggctaattttttgtatttttagtaaagacggcctttcgccatgttgcccaggctggtctcgatctcctgagctcaagtagtccgtctgcctcccaaagtgctcaaattaccggtgtgagccactgtgcccagcccttttctttaatttagactggcatttatgtataccattttcatttttcatcattctttattgtacctcagactttccttttggaattttcctccttgaaacacattgttaagaagccctcaaatgtgctttgtttggcttggaattctttgtttcctgaatctgaacttccatgcattttaattttggaaatttttctaccattatctctttaaatactatcttatctatattctttctgttctcttcttctagaattccaagtagacagactttagtttttttgtctttgtgtgtgttttgtttttgtttttgttttttttaagagatggagtctcgctccgtcgcccaggctggagtgcagtagcgccatcttggcttactgtaagctctacctcccaggttcatgccattctcctgcctcagcttcccaagtagctgggactacaagcacccaccaccacgcccggctaattttttgtatttttagtagagacggggtttcaccatgttagccaggatgatcgcgatctcctgacctcatgatctgcctgcttcggcctcccaaagtgctgggattacaggcgtgagccaccgcgcccggccttgtctttgtgttttaactagcatttcatgtttttatctctctctactgcattctgggtagtttatgccatgataatttattcagctctctctgctggatttattattttctttttagttgtgtttaatctattttttttttttttttcgagacagcgtcttgctctgtcactcaggctggagtgcagtggcgtgatcttggctcactgcaagctctgtctcctgggttcacaccattctcctgccacagcctcctgagtagctgggactacaggcatccgccaccacgcccggcgaagtttttgtatttttagtagagacaggctttcaccgtgttagccaggatggtctcaatctcctgacctcatgatccgcctgcctcagcctcccaaactgctgggattacaggcgtgagccacgcactcggccttaatctacattttaaccagcctaatgagttttgaactgtcgttggttatctttatgatttttggaaggtcttttgtttttcccattccaatatgcctgctctttgttggggtattttttatttttatttattaatttatttattttttgatggagtttcattgttgttgcccaggctggaccgcaatggcgtgatcttggctcactgctacctctgcctctcaggttcaagtgattctcctgcctcagcctcctgagtagctgggattacaggcacccgccaccatgcctggctgatttttatatttttagtagagacagggtttcaccatgttggccaggctggtctcgaatttccgacctcaggtgatccgcctgcctcggcctcccaaagtgctgggattgcaggcgtgagccaccacgcctggcctaggatatcttatttgttcatattttctatttttaaatttattataattttctctatagcattgaaattatctttcttaatgaaaaatgctattccattaaattgatatatctgcctatatattccttatttcctcgcttttagcttattacagtttttagctataatatgtttcagccacaaaaatcttttatacaggaaggtccccaacccctagtactaaatctcaatgaaataactgaaaaatagtagtattaagtcatagagtttaaattcttcttttctcttattgctgaatttcttaaaagcaaagttaccagtttacattgctgcttcctcccactattaggttttgccatttaatgttataacatcaggagcacaaacttctggaggtgtatggaacagattccatttcttacttttaaacatgtgaccttggacatattagttaacctctattttagttcctcatctgtaataagatggctttgaggattaaataagtgacaaatacttggcagatagtaagacctcaataaatctaggccattattttaaaatatttttatttgtggtggttttaatttcttcagtgatgaatgagactaagtattttctgaagtgttttctatttatattttatctcatgtgaactatcaaatacctccttttcttaaaatagaagtttcactgcagaagcgagttgacataataacaccaaaagcacaagtgctgaaagattaataagttggacttcatcacagtttcaaaagtgcaccatcaagagagtgaaaagacaacacacagaatgggaaaaatattttaaaatcatgtagccgagccaggcacctgcagtggctcacacctgtaatcccagcagtttgggaggctgaagtgggtggatcacgtgaggtcaggagttcaagaccagcctggccaacatggtgaaaccccgtcttgactaaaaatacaaaaattagccagcatggtagcacacgcctgtaatcccagctacgtgggaggctgaggcaggagaatcgcttgaacctgggagatggagattgcagtgagctgagatcgtgtcactgcactctagcctgggtgacagagtgagactctgtctcaataaagaactctaacagagtgcaagcagtggtgcagtcatagctcactgtaaccttgaactcttgggcttaagcattcttcttgccttagcctctcagctagccaggactacaggtatgcaccacaatgtctggctaatttctaaaaattttttttttgttagatatgagggtctcattacgttgtccaggttcgtctcaaactcctggccttaagcagttctccttccttggcctcccaaacactggattacaggtgtgaaaccaccgtgcctagccaccaaattttttaaatgggcaaaagctttgaaaaggtattttttccaaagaagatacacaaatggaaataagcacacgataataggcccaacataactagtcaccagggaaatgcaaatcaaaaccacaatgaaatgcctcttcatactcaccagaatgtctacaataaaaaaggacaataacaagcattagcaaggatgtggagaaattggaatttcataccttgttggtgggaatgtaaaatgatgtagccactttggaaaacagtttggcagttcctcaaaacgttaagcgtagagttgctataggaccagtcagttccattcatatgtatatactcaagaaatgaaaacatgttcacatagaaacttacacacaaatgttcacagtagcattatgtccagaataggcaaatttgtagagacagaaagtagattagtggttgtctagggctggggcaaggtggggaagttaatgggtagtgactgttaatggttacagggtttctttttggagtgatgaaaatgttctaaaattagattgtggtgatggttgctctactctgtaaatatactaagaactactgtaatctttcaatgagtgaatttatggtatttaaatgacatattaatgctgtttaaaagaaagaatccagttgacgtatttacctctcctcctgtacattcatctcttgcccagattgttggttagggatgagatagatatatctcatatggtggccgggcgcggtggcttatgcctgtaatcccagcaccttgggaggccaaggcgggtggatcacctgagatcaggagttcgagaccagcctgatcaactccatctctactaaaaatacaaaattagctgggcatggtggcacatgcctataatcccagctactcaggaggctgagacaggagaatcacttgaacctgggaggcggaggttgtggtgagctgagattgtgccattgcattccagcctgggcaacagagcaagactctgtctcaaaagaaaaaaaaaaaaagagatgtatctcatatggtaattcctactgttaggaaatagtatatttcaacttaatggatgtttcattttggtatgatggctgataatttcagtcttgggttctctaggttctgtgtcccctaataccagctgtgtgattcttgtttatctacattatattatagattgttccattgtttataaaattagggtaatttttgctcatccagaggattattgtgaacttcaaatagaagtgagacagcattttgaaagctgtgtagtcctaaataaatacacagtagtgttaagattcctaaagttctctgtattttcttttcataggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactaggtatgttatctgggcctaatttaaggttatagttatattgagggatatatattctctatttttctgtctttccctcatttatatatggtattttcttactttttagaagtcaggagctttacttgttaaatatacattattctcttctttattctcaaagtaaatgatggctgatttttctcacctaatagtgctataacagtggttgtgtttctttgctctatattctccaggaatttcaaaattgaagctaacgtaactaagtcaaaaatgtttgtttaccatgttgccattttaatcagtttcctttgaagggtgttatgttttattgcatttcatattttaaaataaagtgatttaaaatagatgggctgaaaatatatttatcatattcaaatgttggaaaaatacaccttaggagaattttatcagtagtactttgaacagagatgtagtgtttcttcaagtatggcccaagcaccacgtgcatcagaattacttggatacttgttagaaatgaaaatttcttgatctctaccctagatctgctaaattgtaatctctggagatggagtccagaatttgtatgataataagtttaggtggcctttggtatataacgaagctttaaaactttaaaaattatttttacaaaataggaaaatatgtgcatgttagaatcaaacagctcaaaaggattgatctgctgaaaatgaactttggataattgggttatttcttagttgggtaataataaatcaagatattggttcaagtaatcttttttcctttcagtattttccagtggtatttcctcttgacttaaaatatactttgtactcattatagaaaatttattaaaacagagaaagatacagaagagtcatctataagccagtcactcaaagacacctacacatttgtttccttttagtgtatacgcctcttccctgcacacacttttcctttgcttttacaaaattaggttaatattggatatcgtaacatttattgtgagcagtttctgaaggacaagaaatattttacaatctaagcctaggtatcctaaacacttagttactgtcacaagtgaagtctctatatattcttctgcctttttatttttatgtgtgtgtggttctttagttttttttttttttcctctcagatgggtagcgtagtcatcttttcttctactaaaaggtagttcaaaattatgactagcaattctgaggcagttagtggattccagcttattcgaaaattatatctttagtttcccttttccttcttacttagaaatttgggactgaacttcactcagcccttagaagtaggctacatttataatgtatctgtggtaaaggttgcttttgaattgcttatcccctgtcttcctcatgtgattgtttttctgtcttggaaaaatctttttcatttcttaaaataagtaggatgagtaagattttaaacttcatttgacatcaaattgaacttagttcctttagctgattagtaaattctcaaagtaaaagcaccagttgccacctttaaataaatagctgtttctgtctccagaactgtcttttttgagacagggtttcactccttttgcccaggctggagtgcaatggcatgatctcggctcactgcaacccccgcctcccgggttcaagtgattctcctgcctcagcctcctgagtagctgggattgcaagcacccaccaccacgcccagctaattttgtatttttagtagagacgaggtttcactatgttggtcaggctggtctcgaactcctgacctgaggtgatccacccacctcagtctcccaaaatgctgggattacaggtgtgagccaccaggcctggcccagaactgtttttatataggtgactatatgtcctgatttacttgggggcagtagtaacttatacctattattttggtataataatttttattagtgcctcctttcactcacaacagcaacctggtttggaagataaattataatgtctcctatttttatattactatattctgatgcttgaacaagcatgaacttacccatggacatgctttgtttctcttctaatagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatggtaaagtggaaaagccaattgtgtgtatgtgaatgtgtgtgtgtatgtgtttgtacacagttctggagagaatcagttattttatatttaagcctatgtgataaaaatcagaatgactgcataaaatattacagtatgtcagcttaggcaacatagaccccattacaaaaaaatttaaaaattagctgggcatgctggtgtacacttgtagtcttagctactcaggagtctgaggtgggaggatcacttgaaccaggagttcaggggcacagtgagttatgattacaccactgcactccagcctgggctacagaataagaccctgtctctaaaaaacttttttttttttttttgagatggagtctcaccctgccacccaggctagagtgcagtggcatgatctcggctcactgcaaattccgcctcttgggttcaagcgattcacctgcctcagcctcctgagtagctgggattacaggtgcccgccaccatacccggctaatttttgtatttttagtagagatggggtttcaccatgttggccaggctggtctcaaactcctgaccttgtgatccacctgccttggtctcccaaagtggtgggattacaggcgtgagctgctgtgcccagcctaaaaaactttaaaaaaaaaattacagtataccattctctctctgtgggtgccacatttaatatgttccaattattagtaaaatagctttaaaataaagcttgtgaatcatatactattacatatgtttggggcaatattacctttttcatttgatccttccagggtgaaggatcaaataagtttaaaggaagtgatagttttttttatatttaatgcaagagagatttcagcagtatttttttttttttttttgagacagaaacccaccctatcacccaggctggaatgcggtagcgcagtctcggctcactgcaacctccgcctcctgggttcaagcaattcttgtgcttcagcctcccaagtagctgggactacaggcattcgccaccatgcccggctaacttttttgtatttttagtaaagacggggtttccttatgttggccaggctggtctcaaactcctgacctcaggtgatcctcccgcctcggcctcctaaagtgctgggattacaggcgtcagccaccacactcatctgttcagcagccttaattagagacaataacactactctgtgcatcttatgagatacaacagattcatctatacaataatcccttgtagttttgctcctagttaatcttcacaagattgcttagtgaaatgctttagtctgtttaatactgaaaatgcagaaagttttcaacagattttgtctttaatatttctttaaaatatatctataaatattactttgtttattgtatatgtatttataactcagaattccagttctatagatgttaatagatactaggccaaaagcaaaaagaacaaagtctggggaacatttgttaaacaaagttgaacataggtttttgtttagcctcaaaacttctcagaacctttttatgataatgtgcattgtgatatgatatacattctttctcaatattaattgattatggaaccttttgaaaaggaatttcatgtggtattagttttcagttgaacacaggcttgcatagaaggagttagtgaatttttggagtaagtacttttaggtgtaaacatttgaaaagtgtttaacattttctttactactggtaaactcaagctgggctttgcatttcgatattgatgactgttgacagcttaaccactaacagcaaagtatacaatacgtatggtgacactttcaatagataggttcatggagtcctaggaggacatgcttgagctaatgagtaaatacaaagatggtgacactgttagactcattattttcttttttttttctctgagacggagtctcgctctgttgctcaggctagagtgcagtggcgccatttcggcccctgggttcacgccattctcctgcctcagcctcctgagtagctgggactacgggcgcctgccaccacgcccagctaattttttgtatttttagtagagatggggtttcaccttgttagccaggatggtcttgatctcctgacctcgtgatccgcctgcctcggcctcccaaagtgctgggattacaggcgtgagccactgcacctgttccctcattaaacattttcttttctgtttcattactaaatattttagtatgtatcttttaaagatacaaattcaaaataactacaataccattatcacctaaaaattcacaagttttgtaatatcaaatatctagtgttcaaatttccgcagtaagcagaaatttttattgctcttaataactcttaaggaacaaaataaaactgtagatataaaacaaagagtctgctaatttcccggtttgttaatgtaacacatactcaactttgcctaagatcaaaagaacattcttgccaggcacgatggctcatgcctgtaatctcagcactttgggaggccaaggtgggtggatcacctgaggtcaggagttcaagaccagcctggccaacatggtgaaaccccatctctactaaaaatacaaaaagttagccgagcatggtggcaggggcctgtaatctcagctacttgggaggctgaggcaggagaattgcttgaacccaggaggcagaggctgcagtgagccgagatcaaggcattgcagtgcagcctgggtaacagagcaagactttgtctaaacaaaaacaaaaacaaaaaattctttttctcagaatagctacattcatctcatcattatataaaagacttactaaaaattaaagccttggatttgactctaggtaaagtgcatggagaataaacatgaatcattatttgttttagtatactattagtataataattgaaacagactactcatattcctgcttatgtgacatacttgtttttgttttgttttgtttttttgagacagcttcttgctctgtcacccaggctggagtgtagtggcatgatcatggctcactgcaacctctacctcctgggcttaagcagtcctcccatttcagcccctcaagtatgtgggactacaggcaagtgccctcatgtccggctaattttttaaattttttgtagagacgagatttcgctgtgtgacctaggctgatcttggtctccttgggctcaagtgatcctcctacctcagcatcccaaagtgctggggttataggcatgagccaccatgccaggcctgacatacttgtttaattaagagaagtaggcaacaaaataacttattaatataatacatagatgattgaagggaatttgttttgttgactgctctatttttatactgcctaataaaagcatctgggatctttgtttaataacttattttttctttttcagagctatccattttttattttgcccttaaaaaaattcctttttttttttttttttttttgccacaagcatttaactgtgaggtatttaggaaaacctagttttttttttcttctagaaactttttgtctctgggtgctttccagttactttgtgccatttagagcaatgccaggcattcatttaatattttcataaacatggcttttttttcatatttaaacatttgaactttattttgatgagtgaagggttaaaagagatacactacctttctccttatttaagacctcgcctctctcacccagaaaataatcattaatactgtatttaaaattctgaacatcctgtttgaggcaaaatatttgcagagtactgcttcttttgtatgtttttccagagatactctgtatatgcaagcatgattattgtctcttatctgcataggaatagatattaaaagtattattactgtaatatattcatcatattcttaactttatgtttagacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaagggtaaataatgttttctttctttctcctcaatttactgtacctttgtatcaatttttctttgtaaaaaaataggataattgatatacgaataatgccacagattttttaaagatattttgcctcagcataatggagttactaatgatgctgtgtttatgccagtttttccatttgttatcaacacaagtaatgtacccttaactgggttttaagcactgaattatgaaaattattgtgagatttttattcaccattaacaaatttgtgtttcactgtcttcctgataaacttttctctgtattttggagtcttttaatctcagaggctactcaaagcccagctttttcacttctgtatttttactgaaagaataccgtggaagtatttttattcccttttaggcacattgttactattataaaaagatataattgggcacaagtattatgttaatttgaaatggtgatagttttctgactttaacccacagaatttatcttaaaaagaaaaagaatctaacgtaaacccaatctataagcttagtgttgagcataaaaactctttagtgagaatgtggaaaagactaccctttatgctcttgccttttcccccatcagcttgttcttaaaacatatttggtcttcttgatagtaaaatacaagctgccatcactttcataaagagattgttgaataaattctaggcatgctttgctgtcttacacaggagttggcagattttttccataaaggtcaatattagatattttttaggctttggaggccatatgatctctgtcatgactatttagttctgccattatagtgcaaaagcagccaaagaaaatatgtaaatgaaagagtgtggctatattacagtaaaattttatttccagtggcaggtagcaggctgaatttggtctgtggccatagtttgttgacccttattatatcaaaggtttgaattatctggatatctatactacaaaatgaagttagaatttcttttagagtttttctgcttctccaaattggtggttttttttttttttggccaaagattacattataaatgcaaaagactggtctaacattaatatatattattggtgccatccaaggtaattaattcatttcaacttggagatcaagttatattctggagattcctcaatttggattgtttttgatcaataaatttaatggcaataaaatttcatgctctcacaacctcagaatcatcgttccattaaaaaaaattgaaattattatctaggcggtcacctctttcttgctgtttttaacatttatgagctcttttcctctgcctttgttctcagtccaagattatttcactgtatatgttaatgagagtggctatcttgaagggacaaaagattgaccttaaaatgaattttaaacattaacctgtgcaaacagttccatcactaaaaaaaattaaagtcaaaggttttggaatggatcattaattgcaaataggcattcttctttttttccccttctctccccacccccagatggctattttaactgtaaattagacttcaaattttagatatgtctctttttcttactgtcatgtcctttcaccattgaaagaaatttaatttccaatctcttttgtttgtatgtcctccatctatgcaaaacaaaaaattgaagaaaaaaaaaaaaccccaaaaacctaaaaaactaactggctttcaaggctcagcacaaggtgactggaagtgtatggagttattttctctttttagcctcctttgtaaaaaccctggaattctgactggttgggtaaatgtgattcagttttttgttttgtaatgcaactattttgatggttggcttcacagctgaggcgagccaccatttcaaacccaataacaggagacttggagacggtacattacagaattagcaaaaggtaagagatgtgtatgctgcatattttgccctctaatgagtgttttatacatcttacaggaattattcatttaaggaaagtgggtcattttcagtcaccagctcaagtcaccaccctgtatataaacaggataacgcatggataaactgctttgtgtttcacaggtctttctccttcactagaagttctgtttttaacctttaattggtatgttatttttagggaattaatatgctttttatctttcttcagatcaggtgtcaaatatccaggaagtggcctgatacttgttttctttttcccttttgttgccaaagggggaaataaagcagcagcctcctgaatctgggagtagtagtcttcacctatgcagttttctcatattcataaatgctgcggtgattcatatcctccttcatggtgattacgttggcatttgttcatacatcttgtaaaataacattgtcattatgtagtaatctgtattcctcctgtttgagttttttatttaaaaaaattcgctgactcaaaagttggcagtaggaagaacagagttacgcttctgagctctgtcttccaaaaattagttgtaaacttagttgccttttactttgccagagagatttaaaaacagttttatctcagtgagaggtttgaaaaatgaatttaaggagtctactattttttttcaaaatatttaaataacttctagatctgagaaagtttctgtgaaacccagtgctataaatcatttacatacagcttcaaatgattttttgtttaaaaaaagtgaaaggacaataaatctacaacaaaaatctgtcaactcattttctcttgatttggaagtggctgttcttactgccacttttctaaatgtttttgtggattcgagaccattacccaccatccagaccaatctgaacccttccaatcacctgtggcttggcaaaacaaaacaaacaaaaagcccaaaattgcctgctactggagtaagtccttgtcctttctctttttttgtagctgagccgagctacagtacatgaccctgagactggaaaattgaccacagcacagtacagagtatctaagaggtaagggagtaatggagagaactttagtcatatttggaccatttctttcttgggaatctaattttctgaaaactcatgatatagtttctaagacctaggtggttaggcatagatgtttgataatatctgtgctggagttttcatgacggactaataaacatggttatggggcagttaataggggttttccaaagtaacattaacttacataatgtctgttgaggctccccaaactttgataagtgaaatgtgttctcatattgaactaagagaagttcccaaattcccttcattaaacaaggcctcttttggactctgcagtaaagcaggggtttaaaaatctcagggtcacctagtagctgcaggtattgcgtaagtaagtgcctttataacaaagcctttgcaagttccttgcttttaacagtgtttaaagataatcttattaggttattagttgattgatcactaaaatgttttttaaaaagagctcactgtgtaacttagagctcacagaattgggtgacagtattacaatagaactccttttccatctacttgtgaaggtttctcggctctcatgaaaatagaaatatctttgtgctgaatttttattctaacaagtagaatatttatccacagacacaataactaatgaaatataacaaacataagccccatccatctcattaggaacatcttaatacattttcacttgtttatacttgataatgattgtttagtcatgttatttagattaacaaatgtgaataataattatagtaacaatccagaagatactatctttaacacagcctttttataggtctttaacacaggctttttgttttaggaaattcatatttttgttaattgtataaatatttttaatatagataagtataatgtgataaataaaagattttcaggcataaaaatgtgtcactgtaggacaaggtttcttaaccttatcaatagcactattgacattttgagtcagataattcttgttcttgggggctatcttcagctttgtaggatgtttaatagcatctgtggttcactggatgccagtagcacccttccttaagttgtgacaatcaaaaatgtctccagacattgtcaaatgtcccctgataggtaaaatccccaccactacctctagtgactccacccctgttgagaattaactgttctaggataagaatggaatgaaactataacatcaagaaaaaaaaaaaagatgtaaaatgtccaagtattaaaaaatattttgttcacatattttaagtggatgatggtggatatcaaatcattatggtatttagattccagtggatacatttaaagtaatcattttttagaaattaccaacgttttcaatatgacaattcaatcattcgaaactaaattatgaaaaaatttagttgtcaactaaaaaatttatgcaaaggcaaacatagattttaacaggcattttaggaggtactcagagaaattttgaagattactgctgtcttcaaaaagaaaaagattaggctggaccgaatgtgttgattcagcatttcctttttcttttttgggcaggaccatatgccttttatatattaaccttaaacgttactatacacgtcttggtttcttgtctctgctgtataacaccacctgcccttttgccccagtaagagagaaaaattttttttcttgcctatcactagcttcatagctgagacccctataacaaaagacagattaacaagagaaaatcatacaaatttatttaatacaaaatttacttgacaagaagcctttagaaatgaagaccgcagcctgagcaacatgttaaaaccccaactctacaaaaaatacaaaaaaaattagccaggtgtggtggcatgtacctgtagacccagttacttgggaggctgaggtgggaggatcacctgagcctgaggaggttgaggctacagagagccacagtgagccatgagcatgccactgcactccagccagggtgacagagtaagatcctgtctcaaaaaaaaaaagagaaaagaaatagaaaaaaatgagaacccaaagaaacagggaaacctgtgtatttttatgctaggtttgatgagtggatagtcatacagaagtatgatgaacaaaggggatatgatctaatggtaataaactgggggaaacttagcaaagcctgtttgttcacatacctcttggtatctctgtgtctcaggataaggatgttcatttcttccaggtagagagaggatacttctggattgaaagtcttatactactttagaggaaggtcagagaattctttttttttttttttgggggggggatggagtcttgctctgtcgcccccaggctggagtgcagtggcgcaatcttggctcactgcaagctccgcctcctgggttcatgccattcttctgcctcagcctcctgagtacctgggactacaggcgcccgctgctgcccggctaattttttgtatttttagtagagatgggtttcaccgtgttagccaggatggtctcgatctcctgacctcgtgacccgcctgcctcggcctcccaaagtgctgggattacaagcatgagcccgtgcctggcctagacaattcttttatagcctgcttaaggggaaaagagtgggagaaggtcagagagacctgcttctgctcaaatgctacagtgccatattttggggttgagtgtcctgaaccccattagaagacatgaagaaaatttaaatttgccataatatgattttcattttaatcacaggagcaattatccttaaggaacactaatagatagtaaggatttgcagaaactaatttgcatagacatgttttgagatatgatttacagtgcttctgaacattgcaattaacccgatttttacattaagctaattttccattctattacagaacctaattcatatctacaaaaaaccccttctttaaaaaaaataaaaattaaactgttaacagattttatcagattattgcatggttttacacattttttgtcataaagtttgtaaatagctaaatcctctagatttgcatgcttctaggaagcatataaaacaaaattacggccaggagtggtggctcacgcctgtaatcccagcactttgggaggccaaggtgggtggatcacaaggtcaggagatcaagaccatcctcacaaacatggtaaaaccccatctctactaaaaatacaaaaattagctgggtgtggtggcgcgcctgtaatcccagctactcgggaggctgaggcaggagaatggcttgaacccgggaggtagagattgcagtgagccgagatcatgccactgcactccagcctggcgacagagagagatccatctcaaaaaaaaaaaaaaaaaaattcatgaattcgatgttttggaagactgtttgtttttggaaattttctatgtatgcaatgacccttttgaagaaatatccagcccacagtcaatggactgttgccaataaatcaaaataaatcactgtaggaaagtgatctatacacttaaaaaaaaaaactaaatattgctaaacatttcaaacctattttttaaatattctaactttgtagctcttaagcagttttattggatttttgagaaaggtacaaccatacttacatattataaatgatagcagaaggtatttagctactagcattagaaggccgggcatggtggctcatgcctgtaatatcagcactttgggaggctgaggtgagaggatggtttgagcccaggagcttgagaccagcctggatagtatagctagaccttgtctctatttacaaaaaattaagaaaaaaattagctgagagtgatggtgcacgtctgtagtcccagctacccaggaggcttaggtgggtagatcacttgagcctgggaagcagagattgcagtgagctgagattgcaccactgcactccaggctgggtgacagagcaaaaactctgtctcaaaaaaaaaaaaaaaaaaaaaaaaggccatctcagttgccaaatggaagaaaattcgtgttctgatgtcagttaatttaatcccttgtagcctgggaacatctgtattttgaatgatttagaaaggaatttcaaatatctgtatttagagaactgtctaagcgatgacatcactttcagtggaagtaataatttgttccagcatttcagcaaatagaatttttttggcaaaatatttttggaactcctttagtatttaaaaaacataaaacaggcggggcatggtggctcacgcctgtaatcctagcactttgggaggcccaggcgggcagatcccgaggtcaggagatcgagaccgttctggctaacacagtgaaaccccatctctactaaaaatacaaaaaaattagccgggcatggtggcgggtgcctgtggtcccaactactggggaggctgaggcaggagaacggcaggaacccaggaggcagagcttgcagtgagctgaaattgcgccactgcactccagcctgggcaacagagcgagactcaaaaaacaaacaaacccataaaacaaaaaaggcttttttttttttaagaggcagggtcttgctctgtcatctaggcctaagtccagtggcatgatcatagctcactgctccttccaactcctgggcagaagtgatcttcctacctcagtctcccgagtagctgggaatacaggtgctcaccaccatgcttggataatttttaattttttattttgtagagacagggtttcactatattgcctaggctggtctcaaactcccgggctcaagtgatcctcccagagtattggtattacaggcgcgagccattgcatccagccaaaaaaggctttacttatgttactgacaatctgttaacttttggcaagtcatctctgtcttttccactattaaaaagcaaataaaggccgggcacggtggctcacgcctgtaatcccagcactttgggaggccgaggcgggcggatcacgaggtcaggagatcgagaccatcccggctaaaacggtgaaacctcgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaataaaaaccctaagaatttactacagcttgtaaatgaaaaagctaataattttgggtagatcagagaaatggaatttgaagtttttgaaatgtaaacattcagttttgtgctctgaaaagatagttaagtgaactcataaagtctagttaaagtaatataaataatgacctatgcaaataaacaataatctgtttagagtggtagaaaagcttttttgattctggtgggaaagtgattttcatttttttactctgaagtgatgatttcctacaatacggtatttatgatatcatgaatgtaacatgatatatatgtatatgtgtgtatttatttatttattttattttactttattttctttcggagacagggtctcactctgtcgcccaggctggagtgcagtggcacagtcatggctcactacagcctccacctcccaggctcaagcaatcctcccacctcagcctcctgagtaactggggctacgggtgcacaccaccatgcccagctaagttttgtatttttgtagagatgcggttttgctttgttgcccaggctggtcttgaactcctgggctcaagtgatcatctcaccttggcctcccaaagtgctgggattacaggcatgagccaccatgtctggccttaaatatatcataaatatgttatttaggcttaagattttgtttacccttgttactaaggagcaaattagtattaaagtataatatatataaacaaatacaaaaagttttgagtggttcagcttttttattttttttaatggcataacttttaacaacactgctctgtaatgggttgaactgtggtactcagactgagataactgaaatgagtggatgtatagtgttattgcataattatcccactatgaagcaaagggactggataaattcccagtctagattattagcctttgttaaccatcaagcacctagagaagaattattggaaattttgtcctctgtaactggcactttggggtgtgacttatcttttgcctttgtaaaaaaaaaaaaaaaaaaatatatatatatatatatatatatatatatatatatatatatatatagtggttttcgattagctaatcatagaatattcttatgtgtgtgtcgggttagaagaaggtagtgatcatgttcaaattacattactgacatttttctttggagctttccttactcacatattagaagtgtagttttgcagtgtgagaatgttgctcccttactctgcgcattctagtggtattttacaaaatcatgaagttttttttttttttttttaacagcggaaactcagtagaaaggaaaaaagcatagaaatgttactctaattgaatgcacagctttggcttcaggtcctgtcattaaggccaaaaggaacatactttgggctatttaatttttaatggaaaaaaaaggacacatataaagttatctgaagaaatagttcttttttctcctggcactaaattgtgttttatggggaaaaacactgtataattagttgacattttcaattacagttatacaaaagataaatgatcttcaaatgatttttcctattaaatgctataacattaaaaaaaaatcccaactcagttaaagcactgggtactagaaagcaaaacctctggatttcttatgatttaatctaacacaggaataagacttccaggtcctagaagaatggacagttaacatacattacagtataatggtctccactgaattttagtaatgttacaatgtaaattcagagctgagtttttagataacctattatgtctataataatgtcactgaagacagattagcagtaattgttaaggatgggatccagatgagtaacttgaagatagttcttaaactaaggaaagtcttaatgtattttgggccaggtgtgacggctcacacctgtaattccagcactttgggaggtcaaggcaggtagattgcttgagctcaggagtttgagaccagcctgggcaacatggtgaaacctcatctctacaaaaaaatacaaaaattagccgggcgtggtggtgcatgcttgtagttccagttactccggaggctgaggtgggaggattgcttgagcccgggaggtagaagttgcagtgagtcgagatagcgtcattgcactctagcctgggtgacagaaccagactccatctcaaaaaaaaagggagtgttactatattttggaggggattttacatgaaagtcaaattaaatgaaataacttcccatgcatcagtagaattcattttcctctgtagtgactacaacagaactacaattaagatgacagtttgacagttattttttttttaacctacaatcaacattggttttaactgctaagcctcaaacccttcatcaagatttttttttttttttttgagacggagttttgctcttgttgcccagactcgagtgcaatggcgtgatctcggctcactgcaacctctgcctcctggttcaagagattcttctgcctcagcctcccaagtagctgaagttacaggtgtgcaccttcacacctggctaattttgtatttttagtggaggcggggtttcaccacgttggtcaggctggtctcgaactcctgacctcaagagatccacccgcctcagtctcccaaagtgctgggattacaggcgtgagccactgcgcctggccgagatatgttatgatataacaagaaatgcaaataaaaacttaaaaaatttaaaccattaaaatatttttgccttgctaagattgacaaagaataaaaggattgaaactggcaagggttttatgaaatgggtaggtgtaaatcattgcaactgttttggagggaaatttgacatttatcaaaatgtaaaagtcatttagcaattccacatctaggaatttatcgtacagagatactcccacaagtgtgcaaagatatagcattttgttacaatattgtttataacagagaaaaattagaaataacctattatttaaccagtacttaattggtagactttcatggccattcctggaattaaaagtttgtggtggtgttctgttgtttttttaagagatgaggtctcattctgttgccaaggctggagtgtagtggtgtgggcatagcaacctcgaactcctgggctcaagcaatcctcctgcctcagcctctaagtagctgaaactataaacctgtgccaccacaccttgctcattaatttattttaattttttttgtaaagacggggtcttgctatgtttcccagactggtcttcaactcctatccccaaacgatcctcccaccttggcttcccaaagtgctgggaggttattagattttttttttttttctaaaagcagtagtttaaaaggcagtgagggatgggaatataaagtggtgtcactgctgtggaatatagtctgccagctcctcaaaaagtttagggttaccatgtgatctagcaattctacttctaggtacatacccaaaataatttaaagcaaggagtcatatacttgcacacctatgttcataacagcatttattcactatagcccaaggttagaagcaacccaaatgtccatcaacaaatgaatggataaacatgtggtatatatagataatagaatattattcagccttaaaaaaggaaatgaatttctgataccctgcttataacatggatgaaccttgaaaacattattttggctgggtgtggtggctcacacctgtaatctcagcactttgggaggctgaggcaggcagattgcctgagtccaggagtttgacaccagcctggtcaccatgatgaaaccccgtctctactaaaaatacaaaaaactatggtggtgcatgcctgtagtcccagctacttgggaggctgaggtggaagagtcacctgagcccggaaggttgaggctgcagtgagccaagattgcatcactgcactccagcctgggcaactggagttgagaccctgtctccaaaaaaaaaaaaaaaaaccacacacacatgttaagtgaaataagctagaattgacaaatattatatgattcttcttacaggagatacctagaataggcaaatccatacagacagaacgtagaatagaggattaccaggggttgtgaggagggagagatgggagttgttgttcagtgggtacagttttctgtttggttttgatgaaaaagttctggaaatggatagtgctgatggttgtaaggtattgtaaatgtacttaacaccagtgaattgtacacttaattaaaatggtaaaattgctgttatatatattttaccataatttaaaaaatagtctaaatggctaattttatgttacatgtattttaccacaaatttttatttttttagagataggttctcattctggggcccaggctggagtgcagtggtgtgattgtagctccctgcatccttgaactcctgggcttaagtaatccttccgcttcagccttatgagtagctaggactacacaggcacacgctaccatgcctggctaatttttaaactttttttgtggagacagggtcttgctaggttgccgagactggtcttgaactcaagtgattttcctgccttggcttcccaaagtgctgggattacagatttgagacactgtgcccatcctgtttaactttcctgatgttattctttgaagcataaaaggtttttatttggataatgtcccatttatttattccttttgttgcctgtacttttgatgtcatagctaaaccattgcttcgtccaacgtcacaaagatttgctcctgtgttttcttcccacagtttttataattttagcttttacatttaggtctttgatccatcttgagtaattcgttttaatataatgtgaagcagaggtccagcttctttctttgcatgtagataaccagtgtcccatgaccatttgtggaatgtaacaagcatttcttacttttgcagttttaaaggagtaaagtgaaagactggagtggtaatttgctagaatggctaaagtgaaggtatttttcttggtagcaggagacttcaataagcaagcattgacaaggaggagattaaagataaaagggaggcaataactgctggagtaaggcatctagagttagaaagcatagaatcaaaagcatagatagaaagtctgcctctataaggctgaaggacgatgattctaccaaagtacaagaggaaaagataagactagatatttaaaagttgttggtagcagggagggaagttgaagatatcagaagacacgttctctgtgggtgataggttccaggatggaataggaacagtttgttcatgaggcatttagttcgaagctttattagaatgctttccaatttagcattgcaattacctgtaaaaatcaagtcagtagttggttggttgcttataaagttcagacatccatcaaattgtgctaggcaggaaagacaggtacattgacatataccagattagttctaccaggaacttgggcagaattagaagaaaaaaattcttaatatacttaatcagctatattctttacaacaataacactttgattcttcccatttttgctacactgaggaattctgtaatactcagccagtcccaaaaaatttgcaagatatcaccaagcaaataattttagtaatataggataaatctaagaatccaccctgtttgtcatgttagtttcatgttggtaatgattagtaaaaacttctttcttctccatgtctttctcttgttaaagaaaaacccacacactctctcttgctctctctcttacgcttgctcgcttcctttgtctgtctgtggaagctttggcttcgtctggcagcgggagaggtaaaggaaagcttctctaaagaagtggtaactaaggtgatatccagagtcttaattttgcaaagtgaaaaagaatattctgggcagagagaagagcatacgcactagccttaggcctagaggaaatacgttcttgaggaaatgttgctgctgtcctgagagggaggcagaatatagtgttggaggctgtaaattaggagaccaagaaaaagcagcctgagatactagaggaattcctggagaatgagtgtttgagagagtttccaaaaggatgagtattgtcacaaatgttaccaaaggaacaaatacaatgagaattgaaaaatgtcattagatttagaagcacaatagggctgtgggtaagattagcaagagcaattttgagggagtgatataagtgactaaagctagattacagtgggttcagagattaggaatctgacaaagttagcttgaagagggaaaagaaagattggtaactggagggatgtacagatttggggaaatcatttttaattgtaaaggcgtttatttgctctatgaagtaggaaatacattatctactgagtgaagggagaggctgaagtgagttagggtacagagtggaagaggaagtaaagtgaagagcccatttgaagttggtattcatgaatttttagtggaacatatctgccctatttcatgactttctccagtagggtttggtgacagagatatacgcttagataaaagagattgatccaggattgtttttgccagacagttgagtttaggcgtttagaaagaatgttaaaatgatgaactatggaatcaaagctcagtgagaggagaagtgaagaaagcgaaggactgattgactgcttaaaagcatatgtgaaaaagggatatagctgaatttgggagtaccatttaaaattgagatatagttcccgtatcataaaattcacgcttttaaagtatgcatttcagtggtttttagccttgtgcaactataaccaatgtctagttccagaacatttttgtcactcaaaaaaaatcctgtacccattaggagtcatttcccattccccccagccccatccccatcccctggcaaccactaatctattttctattatctattgatttgtctattctgtatatttcatagaagtggcattatataacatgtggcctttgtatctggcttctttgacttaatatgatgttccatccatgttgtagcatgtatgtagagacagggtctcactctgtcacccaggttggagtgcagtggtgtgatcataattcactgcagcctcaaactcccatgctcaagcggctctcttgcttcagctgccagagtagctggaattacaggtgcatgccaccatgcccagctaattttttaaatgttttgtagagttggggtctcactgtattgcccaggctggtctcaaactcctggcctcaagagacctttccacctcagcctcccaaagtgctgggattacaggcatgagccactgtgcctggccagtactttattcctttttgtgacacaataatattccagtttatagatctatcacgttttatgtatccattgataaattgatggatatttgggtagtttctactttttggctattatatgtaatgatgccataaaaaattctgtacaagttattgtatggacataagatttaatttctcttggatatatacctagaagtaaattgctgggtcatttgataactgtgtttagcattttgagcaactaccaaactgttttccaaagtggctgccccttttacattcccattagcaatgtatgagggctccagtttcttcacatccttaccaacacctgttattgtccatccttcagtaggtgtgtttgggtaacttttcaaaacttaagcagtaagcagaatttttttcttataaaatattagcattatgtagctcagactaaagaccccatgacttccaccatagtcagttcctataccttacctggaaagaacgttgttttgtttggtatggttttttaaagaattttttgaagttctcaatgtaggtggctttcaatatagcctccttacattaatccaactgttttcatataagcattataataaatttgattagttttttccttcccaacctctaacagtagaatgtgacatttaaaaaaaattacaatatccattaataaagatgatactaagcaagaaaatgaactaaatgccttcagtaaaggtttattgtcctatatattaaatattatggctttaaaaataacagctattagtctccatgtaatgaaacattatcaataaaactaatattcctcttattcttagtgcctggctctctggctatgaaaatcctgtggtgtctcgaattaatatgagaatacaagatctaacaggactagatgtttccacagcagaggaattacaggtaggtaatcacattatccttaagtcatttttacacttcaggagatgcttgagaggagatttcctgacactgaacaggcagtcctcaatttgcatgatagtttgggaccttaaaaagtgaccctgtaagctgcaaccatgcaaagtgattttaataatgggaaaaattgtgattgttctgtgacttttaaatttcttgtcaaaacatgaaaactcttatctagggaaatgaaaaatatagatcactaatacttactaagtacactgtaattttttttctatcccccaggcctcactttgcctgtcaagtggccagggtgggttttaaaaaatagtgggtttttttcctttttatttatttatttttaagcaaacagttttcctttatttgtaatagtgaaacataggacttttttcatcacttctctttttctgttacttttatgtctataaatcatttgtcatcaaaagtagctgtcccaaaataattcttcttcactccgtcataatcacaacttgactcaaaatatctgtagtaaacaggtatatataggaatgttagttatagggaataaacataaaatccatgtataataatctcacttggtttcaatagtaaaaaaaaaaaactaagcataggcctataaaccagagaaaagaaacagcttagtcttcccctttgtcagcgttatttactattccttagtcttttcctgtagaaaaatactttttaaaatatttgagttcccttttctgtattagattttttttttgaagttatcaaaatgtgcactaaaaaaaccaatgcctttattttagcctttctggttgcaattttttttttttttttttttttgagatggagtctgagtctggctctgtggcccaagctggagtgcagtgacatgatctcgactcactacaacccctgtctcctggttcaagcgattctcctgcctcagcctcccaagtagctgggattacaggcatgcgccaccacactgagctaattttgtatttttagtagagacggggtttcaccatgttggccaggctgctcttgaactcctgacctcaagtgatccacctgccttggcctcccaaagtgctgggattacacaggcgtgaggcactgtgcctggcctggttgcaaaattctaagacagatgcagtcaatatgcagctcataaattcattagaaaggtgatacttttgcttcttttcaacctttctttttctttttgagacagtctcactggagtgcagtggtgcaatcttggatcagtgcgacctctgcttcctgggctcaagtgattctcctgcctcagcctcccaggtagctgggaccacaggcacatgccgccacggctagctaatttttgtatttttagtagagatggggtttcaccatgttggccaggctggtcttgaactcctggcctcaagtgatctgcctgccttggcctcccaaagtgttgggattacaggcatgagccactgtgtctggcctcttttcaactttaaataataaactgttgtccgggtctggtggctcatgcctgtaatcccagcattttgggaggccgagccaggtggatcacctgaagtcaggagttcgagaccagcctgaccaacatggagaaaccccgtctctactaaaaaatacaaaaaaattagctgggcgtggtggcacatgactgtaattccagctactcggcaggctgaggtaggagaattgcttgaacccaggaggtggaggttgcggtgagctgagattgcgccattgcactccagcctgggcaacgagagcaaaactctgtttcagaaataaataaataaataaactgttaatttatcagaagaccaaaatgtattcttaaagacagttaattccctttttctaattaagttttaaaaatgtattttgtgtgtgtgtgtgtgtgtgtgtgtgtgtgtgtgtgtgttttacagtgacacggtttgatgccatcctactccgtctttgtcagaacacgtggtcttttcttctgtttttttttcctatctcaaaattatgaaagcttttatttataacgcttgcagttttttaaaagtgagattcataaaactgtgttcacccaacacactgaatcctatcatgacttggcatgaaaaacagcaacccactcagagtccagtaacactgtgccctcccctgtgatgcacacctgccaggtttattcagtgtttgactgttgttcagtattcatccaacaacatttttgatacatgtggtgctaaatgttgggaatgcaaacctgaataaggtatcgtcctgattcctgcctaatggttttcctgggtttcactggctatgatttctgattcttccctccctccctctgtccctccctccctccctctctccctccctcccctcctctctccctcccttccttcctctctctctcccttccttccttccatatttccttccttccatgtttgcttgcttccttccttccttccttcccttccctccctccctgcatccatccttccctcctttcctttctttcttctctctcttcctccctcccaccctctttatttctttacttccttccttcctctctccctcccccctccccctccctgactcccttctttccttccttccttccctttttttttttttatactttaagttctagggtacatgtgcacaacgtgcaggtttgttacataggtatacatgtgccatgttggtttgctgcacccatcaactcatcatttacattaggtatttctcctaatgctattcctcccccagccccccaccctccgacaggccccggtgtgtgatgttccctgccctgtgtccaagtgttctcattgttcaatttccacctatgagtgagaacatgtggtgtttggttttctgtccttgtgagagtttgctgagaatgatggtttccagcttcatccatgtccctgcaaaggacatgaactcatccttttttatggctgcatggtattccatggtgtacatgtgccacattttcttaatccagtctattattgatggacatttgggttggttccaagtctttgctattgtgaatagtgccacagtaaacatacgtgtatatgtgtctttatagtagcatgatttataatcctttgggtatttacccagtaatgggattgctgggtcaaatggtatttctacttctggatccttgagaaatcaccacactgtcttccacaatggctgaactaatttacactcccaccaacagtgtaaaagcattcctatttctccacatcctctccagcatctgttgtttcctcactttttaatgattgccattctaactggcatgagatggtatctcattgtggttttgcttcgcatttctcttatgaccagtgatgatgagcattttttcatgtgcctgttggctgcataaatgtcttcttttgagaagtgtctgttcatatcctttgcccactttttgatggggttgtttttttcttgtaaatttaagttctttgtagatctggatatcagccatttgtcagatgggtagattgcaaaaattttctcccattctgtaggttgcctgttcactctgatggtagtttcttttgccatgcagaagctctttagtttaattagatcccacttgtatattttggcttttgtagccattgcttttggtgttttagtcatgaagtccttgcccatgcctatgtcctgaatggtattgcctaggttttcttctagggtttttatggttttaggtctaacatttaagtctttaatccatcttgaattaattgttatataaagtgtaaggaagggatccagtttcagctttctacatatggctagccagttttcccagcaccgtttattaaatagggaatcctttccccatttcttgtttttgtcaggttcgtcaaagatcagatggttgtagatgtgtgttgttatttctgaggcctctgttctgttctattggtctatgtctctgttttggtaccagtactatgctattttggttactgtagccttgtagtatagtttgaagtcaggtagcatgatgcctccagctttgttcttttggcttaggattgtcttggctatgtgggctcttttttggttccatatgaactttaaagtagatttttccaattctgtgaagaaagtcattggtagcttgatggggatggcattgaatctgtaaattaccttgggcagtatggccattttcacgatattgattcttcctatccatgagcatggaatgttcttccatttgtgtcctcttttatttcgttgagcagtggtttgtagttctccttgaagaggttcttcacatcccttgtaagttggattcctaggtattttattctctttgtagcaattgtgaatgggagttcactcatgatttggctctctgtctgttattggtatataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctgttttcctaattgaataccctttatttctttctcttgccttattgccctggccagaacttccaacactatgttgaataggagtggtgagggagggtatccttgtcttgtgccggatttcaaacagtgcttccagtttttgcccattcagtatgatattggctgtgggtttgtcataaatagctcttattattttgagatatgttccatcaatacctagtttaccgcattttcagcatgaagggctgttgaattttgtcaaaggccttttctgcatctattgagataatcatgtggtttttgtcattggttctgtttatgtgatggattacgtttattgatttgtgtatgttgaaccagccttgcatcccagggatgaagctgacttgattgtggtggataagctttttgatgtgctgctggattcggttggatttttgcgtcgatgttcatcagcgatattggcctaaaattctctttttttgttgtgtctctgccaggctttggtatcaggatgatactggcctcataaaatgagttagggaggattccctctttttctgttgattggaatagtttcagaaggaatggtaccagctcctcttagtacctctgatagaattcggctgtgaatccatctggtcctgaactttttttagttggtaggctgttattgcctcaatttcagagtctgttatttttctattcagagattcaacttcttcctggtttggtcttgggtgtatgtgtccaggaatttatccatttcttctagattttctagtttatttgcatagaggtgtttatagtattctctgatggtagtttgtatttctgtgggatctgtggtgatatcccctttatcattttttactgtgtctatttgattattctctcttttcttctttattagtcttgctagctgtctatcaattttgttgatcttttcaaaaaaccagctcctggattcattgattttttgaagggttttttatgtctgtatctctttcagttctgctttgatctgagttatttcttgccttctgctagcttttgaatttgtttgctcttgcttctcttgttcttttaattgtgatgttagggtgtcgattttaggtctttcttgctttctcttgtgggcatttagtgctataaattttcctctacactgctttaaatgtgtcccagagattctggtacgttgtgtctttgttctcattggtttcaaagaacatgtttatttctgccttcatttcgttatttacccagtagtcattcaggagcaggttgttcagtttccatgtagttgtgtggttttgagtgagtttcttaatcctgagttctaatttgattgcactgtggtctgagagacagtttgttgtgatttctgttcttttacatttgctgaggagtgctttacttccaattatgtggtcagttttagaataagtgtgatgtggtgctgagaagaatgtatattctgttgatttggggtggacagagttctgtagatgtctattataatggtctgcttagtgcagagctgagttccagtcctggatattcttgttaaccttctgtcttgttgatctcatattgacagtggagtgttaaagtctctcattattattgtgtgagagtctaagtctctttttaggactctaaggacttgccttatgaatctgggtgcccctgtattgggtgcatatatatttagaatagttagcacttcttgttgaattgatccctataccattacgtaatggccttctttgtctcttttgatctgtgttggtttaaagtctgtttgatcagagactaggattgcagccgctgcttttttttttttttttctttccatttgcttcgtagatcttcctccatccctttattttgagcctatgtgtgtctctgcacatgagatgtgtctcctgatgggtcttgactctttatccaatttgccagtctgtgccttttcattgggacatttagcccatttacatttaaggctaatattgttatatgtgaatttgatcctgtcattatgatgttcgctggttattttgctcgttaattgatgcggtttcttcatagcatcgatggtctttataatttggcatgtttttgcagtggctggtaccagttgttcctttccatgtttagtgcttccttcaggagctcttgtaagacaggcctggtggtgacaaaatctctcagcatttgcttgtctgcaaaggattttatttctcctttatttagaaagcttagtttggctggatatgaaattctgggttgaaaattcttttttttaagaatgttgaatattggcccccactctcttcttgcttgtagggtttctgcagagagatccactgttagtctgatgggcctccctttgtgggtaacccgacctttctctctggctgcccttaagattttttccttcatttcagccttggtgaatctgacaattacgtgtcttgtggttgctcttctcgagaagtatctttgtggtgttctctgtatttctgaatttgactgttggcctgccttgctaggttggggaaattctcctggataatttcctgaatagtgtttttcagcctgtttccattctccccgtcactttcaggtgtacaccaatcaaacatagatttggtctttttagatagtcccatatttcttggaggctttatttgtttctttctactcatttttctctaaacttgtcttcttgctttatttcattaattccatcttcaatcactgataccctttgttccacttgatcaaatcggctaccgaagcttgtgcatgcaccatgacgttcttatgccatggttttcagctccatcaggtcattcaaggtcttctctacactgtttgttctagttagccattcgtctaaccttttttcaagggttttagcttccttgcgatggcttagaacatgcttctttagctgggaggtttgttattaccgaccttctgaagcctacttctgtcagctcatcaaagtcattctctgtccagctttgttctgttgcttgtgaggagctgcagtcctttggaggagaggaggtgctctgatctttagaagtttcagcttttctgctctggtttctccccatctttgtggttttgtctacctttggccttcgatgttggtgacctacagatggggttttggtgtagatgacctttttgttgatgttgatgctattcctttctgttagttttccttctaacagtcaggtccctcagctgcaggtctgttggagtttgctggaggtccattccagacgctgtttgcctgggtatcaccagcagaggatgcagaacagcaaatattgctgcctgatccttcctctggaagcttcatcccagaggggcacccgcctgtatgaggtgtctgtcggcccctactgggaggtttcccccagttaggctacacgggggtcagggaccctcttgaggaggcagtctttggttctcagagctcaaatgccatcctgggagaaccactgctctcttcagagctgtcagacagggacgtttaagtctgcagaagttgtctgctggcttttgttcagctatgccctgcccacagaggtggagtctacagaggcagtaggccttgctgagctgtggtgggctccgcccagtttgagctttctggccattttgtttacctaatcaagcctcagcaatggtggacacccctcctccagccaggctgcaacctctcaggtccatctcagactgctgcactagcagtgagcaaggctccatgggcatgggacccactgagccaggcacaggaaagaatctcctggtctgccagttgctaagactgtgggaaaagcgcagtatgtgggcaggattgtccggtttttccaggtacagtctgtcatggcttccctttgctaggaaagggaaattccctgactccttgtgcttcctgggtgaggcgatgccccgccctgctttggctcattctctatggtctgcacccactgtccaaccagtcccaatgagatgaaccaggtacctcagttggaaatgcagaaatcccacatgtgagtgagaacatgtgatatttgtctatgctgggcttattttactaatataatgaactccagttccatccatgtgataagattacattcttcttatggctgaatagtgtttcattatatataagcaccacattttctttatccattcatctgttgatggacacttaggttgattccatatgttagctgttgtgaatagtcctgcaataaacatgggaatgcggatatctcttcatcatgctaatttcctttcttttggatatatacttggcactgggattgctggatcatatggtagatctatttttagtttttaagggaacctctgtactgttctccatagtgattgtactaatttacattcccaccagcagtgtatgagcatgcccctttctcttcatccttgccagtgtctgttatttttgggtttttttgtttgttttttcttgagatgtagtcttactctcttgcccaggctggagtgcagtggtgtgatcttggctcactgcaacctccacctcctgggttaatgcagttctcctgcctcagcctcctgtgtaactgggattacaggcccctgccaccatgcccagctaatttttatatttttagtagagacagggttttaccatgttggccaggctggtctcgtactcctgacctcaggtgatccatccactttggcctcccaaagtgctggaattacaggtgtgagccactgtgcctggccaggatgctgaatttttttgaaagctttttctgcatttgcagagatgatcatatggtttttaattctgtttatgtggtgaattacatttattgaaccaaccttgcaccccacaaataaagcctaattgattatagtaaattaactttttgatgtgctgctaggttttgttttctagtatttttttgagtattttgtgtctgtgttcatcaggaatatcagcctgaagttttcttttttcattatgtctgtgatgagttttggtatcagaatgatgatgctggcttcataaaatgagttaaggaaagattcgttctcaatcttttggaataatttcagtaggattgatactagctctttgtatgtctggtaaaattcagctgtgaatccatccagtccagagctttttttggttagtaggttgtttttttgtttttttgtttttaattaaaattgaatttcaatttcagaattccttattggtctgttcagggtttcagtttttttctgtttcagtcttgggaggttgtgtgtttccaggaatttatccatttcttctaggttttttataaaagtttgtgtgcatagaggtgttcataataatctctgaggactttttatatttctttggggtcagttgtaatgtcacctttgttatttctgattgtgcttatttggatcttttttctttgttaatctagctatcttgctgtttctagaattctttatttgtctttgatgtttgacaatctgactgaaatgtgcttcagaggggactttttttggttgaatctatttggggacttttgaacttcctggagttggatacccttatctcttccccagacttgggtagttttcagctattattaaataggttttctgtgccttttacctttcttctccttttggaactcctgtaatacaaatgtttaatggtgtcccagaagtcttgtaggctctctttatcctttttcattattgtttcctttttttttcccctctgagtaatattaaataatgtatcttcaggttcagagattgttttgcttaatcaagtgtgctggtgcagctttgtattgtatttttaatttcattcattgaattctttttttttttttttttctgagacagagtctcgctctgtcgccacgctggagtgcagtggcaagatcttggctcactgcaacctccgcctcccaggttcaagcgattctcctgcctcagcctcctgcattcattgaattcttcagctgcaagtgttttgtttggttcttttttatgatatctttctttgttgaaattctgattcatatcatgaattgttttcctgatttcattgaattatctatctgtattttcttttatctgtttgagtttccttaagatcattatttgaatttttttctagctaggtgttgatttcctttacatttgggcctgtaactagagagttacattctcagcagtgtcatatttcattgctttttaatgtttcttgtttcctgcattgatgtctgtgcatctagtggaacaattggctcttttaaactttccgcttctgttgggctgtttgggaagggtgtggtgactctgtttccaggtaggttcagtactgtagtctcttatagcctattcagctgcattcattgtcagaataactgtgggtgcctcaacagcctaggctggagaagtttgcagtggtggtagctgtggagtagattgttaatatcttcagtggcaagagcttttggaatccttccattcttgttttccccacaatagggagttttagccagtgggagtcttcttggtggcaggtcttacatatcctacaagcagctgccatggtgctgcaatccaggtgcaagcgtttggagtggctatggggctaggatcctgggctcagggtcttgcatactattgtaacacctgggtgttagggtacagggtcactattggcagggttggatgtaggttgcctatagtgccaggatctgtgactctgaggcaccctctagctgcttgggaaaagagtgtcaggttgtagctgtgagtctacccctggtggacagggcacagccctggcccaactccagggaagagaggatgctctggaggtttgagtctgggatgcagggtttggctctattaggagcctgagccaatagggcttagtggcaactcctatccctggggatgaggcaccatgatgaggtgccctggatgaggcaccaggttctagtagtcactctagaacctggattggtggagctcagatggatcccagactctgaggccaggtacagcaggaacaggcacccctgaatggccaagcatgcctgttgtttgggccctgtggggcagagagcagcacagcaatgacttcactccctagaaagagaagtgtctcagcagcgcagactctccagggaagcagggtactagagttatttgccctgcagggcacatttctcagcttagccactgctctgtttccctgggtctctgggtactacttcagccctgggatgtgcagctgctcagcttggccagtgcaacaattccccaagggtgatgtgctgtttcagctcaggctcaggggacgtgactgttctgggtggcccagacatctcatgggatgcagggttctgccaaagtactattttcttgggagggagtacatggctgcagctcctgcctcagggagttgggggaggggtgggtagagcagttccacctctcttgaccccaccaggaagggtgtaacagctgctggcagctctgcttgggaatgtcaggccttcaagtaggccttcattcctggcttagcttcagggatgaaggggtgctgtggctactggccccagagcaagacacactccagcagttccagttccaccagtattctccttctggtttcatcagcagcactcttaattatgttctcctttgattttgtcagcattttattgtgttgtgtgattgagggaaagagttaagtatcattctcttcactttaacaaataagaaaactgagatgatatccaaagttacattgtaattaagagagctggaacttgaactcagaccaaatatttttcttaaattttggtgcgtcacactgggacattgtcgtaagcaactgaagttgttagggcccttcgacaggaataattaaattggtgttaatttctttccttttttagcagggaaaaaatatgtaagaaaagatattttattaaagtggattgcgagttcagcatttggggctttggaaaacattttttgatttaagttccaaaggaaagtgtttagtgaaacaaaataatagaaatctcaaattttagcttatgtattaaatttttaaaaattagctgggtgtggtagcatgcacctgtagtcccagctactcaggaggctgaagtgggaggatcacttgtgccccaaaggttgaggctgcagtgtgctctgattgcatcactgcactccagcctgtctctggtggggggtggggaggggtacatatgtagatatagatctatatatatagatatctatatatgtagatctgtatagagatatagatatctatatatacatctgtagatatagatatctatatatacatctgtagatatagatatctatatatacatctgtagatatagatatctatatatacatctgtagatatagatatctatatatacatctgtagatatagatatctatatatacatctgtagatatagatctgtacatagatatatagtagctgtcctttgtttttcatccctgttttcataggaactcttgttgattttaaatatttttcatttctctgtaaatacctgaccatgatctataaaagtccaaaaaatgaggttcatagattttttttgaatagtaatctttatagttcttttctttcatgctttgtgtctttccttcaggtagcaaattatggagttggaggacagtatgaaccccattttgactttgcacgggtaagtgaaaaagaaatggagaaattcactgaggcttatgcattacattgtttgtctcaaaacaaaacaaaaaaacagtctcactctgtcacccaggctggagtgcagtagcacgatcttggctcactgcaacctctgcctcctgggttggagcaattctcctacctcagcctcccgagtagctgggatcacaggcatgcgccaccatgcccagctaatttttgtatttttagtagcgacagggtttcgccattttggccaggctggtcttgaacttctgacctcaggtgatccacccacctcagcctcccagagtgctgggattacaggcgtgagccactgtgcccggccgcattacattgttaaagaaaaagttattcttgacacttgttaaagatggtaaggcagacttcattcaaggggggaccattgcgataggtatagggaccactgcaaatgcagtgggattttgcagtaagggagagaggttaagcccaattccaaatacaacaaggaaaagtgggaatttatagccaatgagcaagggtgggtgttagtagatggaaaattactaagaggtaagggaagattctggctaaactgacctaacaggattcttgctgaagtcagggaagagtgatcatcatccaggggatagtggaagatgaagaacccagttaggttttgagggtgatcacatggcaaggacggggaattctggctaacctgacttagcagggttcttgcttaaattggacaatgcagaggtaaataccagaagcccaaagtcagggcctacttgagaagaaagttcagaggagcctgagtagttgggtcaaggagagattctttgtcaacatgttaattctgttattttaacattaaaaattcatagcctatttggaatttatggaaatacggtgtggcagatattctgtgaaacctttttaccagttaaaaaaaaaaaaccaaacacctagatacccaataaaatcacttaagatactttaaatgcattggcaagcctggaagaaagtaaagggtgttccaaaaggcaaactgaacaatgatcccaaacttagagaattaaagaggggacaaaacacagaggctggaggtatgtgcctccaggaactagagctttgggaataacagctctgtaagaggaggatctgccacagtgtaggctgctgaatttgagaccctggcataaactctaaatctccacaaggattacaccttcagtaaagaaagaatgggtttgaaaataaatctcttgtgatacaggagccttatggggaactgtctgtttccatcctggctggggcatagtgtgtatgataggggagctacttcagggagtactatgtatggaattttccacttgtgtcatgttagcactaaaagttttgaacttcagagcattttgcattttggacttttggtatgctcaacctgtattccatgttacggatataccacagtttagccattcacccatcgaaggacatttggatagtttttagtttttggctattacaaataaagatgtgtttacatttctatgtgaaaaatgcattttcatttttctgggagaaatgccaagaggttgtattgtattttaatttagatataaatatttagatattaattctttagcttgattatagtgctgaaagtcactttactagcattattagaaaaataatactaggggccaggcgtggtggctcatgcctgtaatcccagcactttgggaggccaaggtgggtggatcacttgaggtcaggagttcaagaccagtctggccaacatggtgaaactccatctctactaaaaatacaaaaaaattagccaggcatggtggtacacgcctgtagccccagccacttgggaggctgaggcagaagaattgcttaaacccgggaggtggaggttgcaatgagctgagatcatggcactgcactccagcctgggcgacagggcaagactctgtctcaaaaaaaaaaaaaaagaaaaaagaaaataatactaggaaatatttcagtaggtcgtgagttcaaagtaagtctcaaggtaaattaagcttcaggagtatagctaagagatggctgtcaagtcatattttttagaagctaaaattgtgggtatttgtttttaaaataatatgtagcttgcagataatggctgtcgtttaggctaataagtctgctttttatccagtaatcttgtctaaagtatccagtatacaagttcagtcatcacgtatttgaggccaggtacagtggctcacacctgtgatcctagcattttgggaggctaaggcaggaggatcgcttgaggccaggagttcaagatcaccctggtccacatagcaagactccatcttacaaaaagattgcctgatgtttatagtgcactggacattacaagggaaacttttgcggttgttgttggcatattcttcaggatattactactgatgtttagttgccactagagtatttgtattactgaatttttacaccattgaatttactgtgtttttattcacagaaagatgagccagatgctttcaaagagctggggacaggaaatagaattgctacatggctgttttatgtaagtcgtcactaaaatttttagattaagttgggatttgatgacaagattcattttaatgttttaagtttgttctgtgtagctctgattcagcatcctagtttaacatttttacaactgaataaagtgagttaagaattattttgcacttgcaactttttcaggctataagatagatgttcattatagaaacttctggacaaacttagaatttatagtgccactacctgcagataatcattaatattttaacatatagtctctctgtttagtaatatataatatgtgtatataaaaatctctatatatttgaatttctatacatacacatacacattatttcagtaaacttctgaattacatttttttattgaagtatatcagaagagtgcgcaaattaagtattataacttaattttcacaaagtgaacacttctggtgtattcagtactaagatgaagaaatagcatattacaacccccagaaaccctatctcagagttttaaaacagtatgatcataattcaatttttaaaattgtttatatatttttatatatggaaaaaagttttgattgtagtgtttgttctagttaccccaaataaagcactccaaaactctcctttctgagtggtttaaaataacaacgattttcttaatgtatctctaacagttatgaggttgactgggctcaactcatggttcctgctccaaatctgacatgtatttgccgtcaaatgcctggcactggggtatcttgaaggctaaggttgaggctggctgtcagccagaatgcctaaagtctggccaatacatgtggctgagcttcttcacagcatagtgactggattgcaagaggaagcatcccaaaagaacaatgcaaaagtacatggtattgttatgacctaccctcagaagtcacagatgttaattttgctgtattctgttacagcaattacaaaggtctgcccagcttcaaggagagggcacacagaccctaccactgcagacgaatgtcagcgtcacataaaaagagcatgtaggatgggacatattgggatgtattatatttggaaaatgcaatctgccataatgtcataacctttgttaacttaaaaaagatattttaggccaggcacagtgacacacgcctgtaatcccaacactttgagaggccgaggcgggcagatcacttgaggtcaggagttcgagaccagcctggccaacgtggtgaaaccccttctccactataaatacaaaaattagctgggtgtggtggcacacacctgtagtaccagctactcaggaggctgaggcacgagaatcacttgaacctgggaggcagaggttgcagtgagccgagatcgcgccactgcactctccagcctggataacggagcgtggctccatctcaaaaaataaaaataaaaaaaatatatatattttatatgtagacttaattttggttatttcatcactttttccattccttagccctatttgaattacatctttttgttgtctgtagtatctcactccctaccaaaatctgtctgttcagtctatttcctttttctcttcctgctaccttccctgtttgttttctttcccttcttccctatctccttcctctccgtatgcctccttttctccccaattcccaatttgtatttctctcacaactccatcttgtttccaaaaggaggtaaggtacattacaaagattcatataaaaaaagagaaataccacaaagggaaaaccaggagagggttagtacggtatacaaattcatgctgcaaaggcttgcatattttctagaggtgagtcttagaggttgtaccagtttatatcccaattttaagtgggatatgtttgtgaagtatgtttgtcagactttttgatctatgtatatttcacttattaaattagcagttattgtggctttaatttgcatttctcttattagagaggttgagcatcttttcagatgtttaaaagccattagtgtttatgtgttcctggttctgcttatatttctttgttttatgaatattgatgctgtattatttggcccactatctgtttctccctcttaatgtaaacacccttcctgtttttctaaaatagttgtatagcattttaattgattatcattttttccgttatttaaataccattcccagaggggcacatagaatatctcaaattacttttcctctcatgcacaactttttaatttcctcagagtttaattttttcattggttaagtgttcttagttctttactattagttatgtatttatcattgtaaaataccttctatctcatttaatgctttttaccttgatttaaactgtatctcatactaagatcatatcctgttttccttggatagcatttgcccaaaatcttacatttttgtgttctgtgtttgtaagtcacttgttttagatgcagctctgatataatatgtagctgggttttgctctgtgatctaatcagtctatacattctacttatgttgctttaaaaaaatctttatgatccatgtttcctttgccttgttttttgtgattctttggttaatttaaaaggtttccatttttattctaggttatctttatgactataactttatataatcctttaactttctcacttttatttaatatgtttgattcccttccatgagaaatggcaaaactgagtatttttattttacatttatttaaatatttcttgagcacctactgttcttgaggtactattgttctagacattaatgatcagcaatgaacaaaacagatgaaaattcctgcctccatggagattacattctaatacaataaaatacatatttatatctgtgtattgactcattagttttaagtcattactttttccctctggctataaataagttcctatctcaaattatatccccagtcttccatcctgatagttttttgttattcattcctttgctttttgtagtttttttacttatgtatataaacctaaatggcattttatttttgaaaaactgagtagcatgtaccaaccatgctatataagaacaagtccatatgttcccaatattctagtatccaatatcaagtctatataatggcatgttttactttattctaccagcacttttgataacaccctcttgtttcttatagatgagtgatgtgtctgcaggaggagccactgtttttcctgaagttggagctagtgtttggcccaaaaaagtaagcctgtttgttttgtttttggtttattaattttttccctaaggaagagatgcacttgtattcatggtctaattaatgaattacatttttttttctttttcattttttgagacctgttctcgctctgttgcccaggctggagcccagcagtataaacatggctcactgcagctttgacctcctgggttcaagcctcagcctcccaaatagtggggactacaggtgcatgtcaccatgcccagctaatgtttaaattttttgtagagacagtgtctccctgtattgcccaggctggtcttgaactcttgggctcaagtgatcctcccacctcagcttcccaaaatgttgggattacaggcatgaacccctgtgcctgaccaaattacatttttaaaggtatttttatggtccttgccacgagtacttagaggtaatgaatgaccaggaattagtatttaaaatttttcatttctaaaatgggttctgcattgtgttttcccctccatcttgctatgtaagatatgttagctttcttttggcaaatacttttgttgtcaaacatttttatggtatttttcatatgatcaaaaacggttcttaaagtgatataaccatattttcagaattatattagaggaaaataaaatactgctatagagttcttccgcaggaacaaagggaaaattactgctgaaaacggccgggcacggtggctcacgtctgtaatcccagcactttgggaggccaagatgggcggatcatctgaggttaggagttcgagaccagcctgaccaacatggtgaaagcccgtctctactaaaaatacaaaattagccaggcctggtgttgcacgcctgtaatcccagctatttgagacgctgaggcaggagaatcacttcaacctgggaggtggaggttgcagtgagctgagatcgtgccattgcactccagcctgggcgatagagcaagactctgtctcaaaaaaaaaaaaaaagtaataactaccgaaagcaattacctggcattgtatacttggggataattgtgaattgttctccatagggaactgctgttttctggtataatctgtttgccagtggagaaggagattatagtacacggcatgcagcctgtccagtgctagttggcaacaaatggggtaaatatttcatatattctgcgaagataatgtaatttttgtttcttattttggaactattatctgtgtcttaaaaacaaaagcccccatgtttgcttaatatgattttaacattgtacaggattcagccaaacaagtgcctaatcataatacaaatttgaaatcagaattttgatgacagattttatttttaactatttttacttattccaagaaacaatgactgactcaaaattgaataagacaatatcttcccctcaaagggttaataatctgattgagacatactaatggattataatgtagtacatattaatacaaaaatgtaaacagaagatggtgactgcctaagtttggggagtcttcttcaaagctttttctttaaatttggtcctgaagatagaacagcagttttccaaacatgttagataccaggttctaatgtgaggctcgagtagcacctaatgtgcaaaatttaaagaggcactcactctcagtcagggacatgcaagtgcaggaccacatttttaaaaagtaaaaagaaacaggtaaaattagttttaatatctattaattagccccatgtatccatttcaatctgtgttactagccacatgttgagtggttacatacaggacattacaaggttaaggagtgaggcctgatcaggattttaaaatctccccttatgattatagtgtttaagaaccactggactagaatgaggagaggctagttggtgagagagagtttagaaagctgttttctgttgtctaagtgggagatgataatggcctggattaaagcatcagtgaaagggttggagagcaaatagatttgagagagatgtaaggaaaattgtcagggtttgatgaataaagtgtagatacaagggttgaagaaggaaaaagagttaagaattaaggttcctgctttagatattttgactgggttctatggtaccagagacaaaaaaaaaatagaaaattaactgcttttgggatacatttttacatggtatacattttttaaaggtattttggaaacttgatgagcatacaatagcaatggttgataagagagttgttcctttagagtgcaaagtttgtgttcattattgtctttgtattttggaggctgtactttgaaaacaatacataaagcaatattctactcttacctgtacctgtatcttaggtccatttgtgtctcatttcaagcctcacattgaacattggaaactgtaagaaatgcacatagactggcaaatatacatgtgtatacatacatgtatgtacatacacgcacacaagtgtgtacacatatgtatataggtatataaaatctgtgttttcagcatttagccaagtttttaagtagcatctgcctttatccggttttggtgttgaacttttatcccatgatgaaactttgttatagacctagcttttagaaactaattaaatactgattagattaagggggaaaattaatatattacttttctctcacagtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaa

SEQ ID NO: 12 - DNA, 35254 bp, homo sapiens
aagggaggaggcgccgagctgaccgggcgacgccgcgggaggttctggaaacgccgggagctgcgagtgtccaggtgagcgccccgcccgctcagccgccagatcaaccttagcgctggggcgcgggctggggtcgccaggcggtgcgttctgcccgcgcggggctgagagttaggggccggggccggatccggggccgggggtcgcgccgctagccgccagcagcgcagtccgggccgccaccctgcaccctccgccctgtttctgcacccgtctgggttcttgtgccgccgcccgcaagccttcccgagctcagggtggtgaggtcagcggcgcccttcgtgcagttccctcggctgtcgggcggggctgggaacttggccgctcttccctgtcaggctcccgggaagtggcggcctgaccccgggctgccggctgttgggagcgggggcgcggcgtccgcctggccctgaggggcctcttcatattggctaagcccgttctgcaccctcccaagggctgggagtcctaggtcttgtccgggcagggtccagcttggagcccattagatgggccattggatcagaaagtcttttctcccccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccaggtgggtccctggcctttgtattctatttgactttaagatggtgcaggagaatacaaaaaactatccgggcatggtggcgcgcgcctgtagtcccagctactcgggaggctaaggcaggagaatcgcttgaacctgggaggcagaggttgcagtgagccaagatcgtgccactgcactccagcctgggagacagagcgagactccatcttaaaaaaaaaataaaaaagagagatggtgcaggagagcattgggatccctcccaagactgtgactgttgtcttttgctgtagagtgacacccgagatttgtgcttcttgataatagactacctggggcctcacagccccagccctcttgtaggaaatcctgtcctaggagcaagggctggagtccgttacgttgtagcttggggcattcttaaatgtcccagactttgtggagatccattgtccacctaagaatttataggatgtttttggggtctgctgcttgttctcagcctgtgtctcatctgacattaggttccataatttagtctctgttaaatgaactaggatttcctttggcttgtacttaaactgcccctgaggtgtccaaggtgcagcctctcactgtggttctgggcctcagcgcccagtctctctggttgcttctccccactcacagaatgtttggtctttgaattcttttcttttagggcctccttgttcttacacagccgagtgtccactgtgtggcccagccaatgaagccacgtagcaaggatggagtgagttggctgggggcctcatcccaaagatgctgtcatactggatcaccctagttctctgagagctcagcaggcagacttggtgacagcttagctgaggcattgtctgtggcatgtgataggcccttgtatcctgtcgaaagctctgcattggggtactctagacagtgcttacttagtcaccggtttagactggccccagctgatctcagttcatcccttgagtgccttctgcctgtttggcttctgactggagcgtgcctggggctagaatgagggacgagagagaggaggtggccgaggcactattcttgcctgtgggtagctcgtactctgagattgctgcttcatattggcagctggccatgtgccaggggaggagcccggctgtgagtgctcatcaaaggaagagactacgtgggtgcagctctgaggaatgagtcggttgagggaatctagggtctcctcatttcctaagaaggcctccctttttcactctgccctcccacatccttgggagggtctgagactggaagcaaggccttggctgatgtgtggccacgctggctgatagtgtgcagagggctaggaggtgtgtccctggctcctggggtctgtcaagagtttactattatgcagatggaagttggcaggaaaagctgtgatgcaagtacatgcaagcccagcagagtgctggagtgagagttaaacttcgggaaagttgctcacatctagcaatttggacatttgaagttccttagggtaagacatcagcctgtcctagagcaaagagggctggaaggtcctgtggtctgtgggctttgtgttacggacatggaatgagagatagaaagacagttttttttttttttttttttcctcagagcagaggagaatgaaaagtctggatgatttactggagccctagaagagagttcttgttcagctggtgtcattgcagggcagaggattaagtgtttgggtagagtgctctccagctcagatggaatctatctgagcctggtaacaggccagcatctgctctggacctttcaggaagtgcttgcttagagtgtggcctgttttgtacctggcactctgagggccagggtgtagtggagatcctcaggcctgggtacttgtaggagcctggaatgagcaggtcagaggcatataagtacatgagttcctagagtattggtccaatcccccgccttttgctagagaacattgcttgatgagctttagagccagtgattgaccagttccagggttatcccctgatgatcaatgtactacattatacctgattccagtctctcctgaattaaatgtttcatttcttgtggtgctcctggaacatggagatcgcccaatttctgccttgtttgcatcttcactgttccctagtctggaccttctttctcacccaggaatcagctgacttgggctgggcagctggctgcctcaggtccactgatgtttctctggtgcccttggtactaatgattgacataaattatgcctagtgcagggctacctgccaacatctgtcatcacattcagtcctccaacagccctatgagatataggtcctagtattgtctctattatatacatggggaaactgaggaatcctataacttgtccaaggtcacaaagccgggaagtggtatagaattggggtttaactcttagtatgtctgaccctagggcaggtgtgcctgtccatttgactgtactgccttgccctgagctggactggctggttatttgtgagtgctgtcatgtctaaggtaggagtgactgcccatctgaacttaagggaccatgttgctgttttctgggtccatgttgcgttcctccctctggtgagatccagccaggcgtgtcatggacctgctttatgaacctttggtgtaacccatgataaagtccttaacctgggcaggcatgttcttcctgggcaaagtgtggcttccctgtttgggagtccattgcactttaaggtaacagattattgagtaggactggatagctgcaatatctagcagagtgtgttttgggtttgactcttggttctgtcattgatttgctgtcagatgtcagatatgtaggaaaccttctctcagcctcagctgtttgtcatttgtatctatcttatatctgaaatggaggtagttatctagcttagaaggtttgggtgagaattagatagtagaaatgaaagatttttggaaacaaatagtgcttatctcagactatgttcccaggaaacagcctgagacagagcttaagtacttaatgctttattggaaggtgtaattgcagggcagccagggtgagggaaaacaaaagtgaggtgcaggcctgtgcgatggctcatgcctataatcccagcactttgggaggtcgagatggatggattgcctgaggtcaggagtttaagaccagctggccaatatggtgaaaccccatctctactaaaaatacaaaaattagctgggcatggtggcacacacctgtagtccaagctactcaggaggctgaggcaggagaatcccttgaacctgggaagtggaggttgcattgagccaatattgtgccactgcactccagcctgggcgacagagcgagactgtctcaaaaaaacaaaagaaaaaagtgaggtataaaggaggatgggaggtggtgttttagcaagctggctactctgcacagagatgtacttggttaccctatgagggccctttggtagccactggggaggccagtctggtacttcaacagagtctggagatagtgagaggagccagagattctggcgtgggcctggatagtctcctccactgggctgaggcaaagtaaataccctgggacctgggagatgggtgagaccaagaggttgcaaggtgggacgtaagatgcatccaatatagtggtatatggattttatcctcaagtgtagttcccttttgtgggttagtctcatccagactgccaagtctctgccaagactatgactgaaaacccaacttggcttttgcatgtcagttttaacagccttctctgctacttcattgtctagttactgaagcaagactttgtggtggtgatggtacccaggtggggaagtggaagtcaaccactattcatgtaccagactgagaaagtatgtggatagatacagataaacatcttggctttattaggttcttcgtgaaggagaatattttttcacataaagtagttgttgaagatacgaaacctggcatggtgagatgaggctagagagggcagtagggcctggtcacacactcaaaaggaccctttgggctaaagagtttgaactttatcttgacggcagtagagagccaaaggagggctttgataaaccatgctggctactttgtagagcagaggtgggaggaaggccagatgacatgtggagaggccagtgtagtgggggccaggatgcctgtaggggaagttaggggtggctcagatcagggtgatgactgaggctaaggagagtagggtaccccccatacttgcctagggtgccgtggcagcagcttataggcctgaatggacatccatgtgctttggtggcagggtctcctggagcctctggatcctcttaggctgaacacacaggtcctttcagccctgttatcctagagttggaggcagcggggagccgtgtccagttaggttttcccccttcacagaaggcaggcaggttcttgttcagtgccaagcaagaccagtttgttctcagcaagctcatgttctgtctctaggctgttaaatacattgttaaaactcaggctgttgcatttgggttgcagctgggagcttggcagagattctgcctgatgaggtaaggagagaagctaaggacgctgctggtttgcagctggaaacatcttttcatggccatttggccagattgtaaatgtcttttccaaagttcaggtttggtgggacctctggttgtatgtcttggaattgccctgtgtttagaaacagtgccagtcgcctgatgggtgaatcactgttgctgggatgttggcaggttttgcaggactttcctgtgggggtccaaacactagggctggcagggcccgtttggagtctgtttgagaagggcctgctttgttttctttacattttaagcatatgataaaataattttaaaaattgctatagaatttcttgtagaaagattagagaaacaagcataaaaataaaaagaaattatttcaccaagatatagccagatgtatgactcttttcttgcatctctctatatacacatatacattaatttttccttacaaaaatggaattatagagtgcatattattggggcccacttttctcacttaacagtatgcttagatctcttcatgttgatatatagtattcatttttaatatactccataaaaactcattgtatagaagaaatgtaaaatcttctattgttgtagtttcctaatttgaacaagtctgtggtgaagtattttttgttgtgttcctggtatgggacagacattgttctaaactctggggatgcagcacagataaaactcagtattggttttctgctcaagatgtcactttgtttttcataaaagtgggtttgacattgttcacctccagacttattccagttggattctgagggtttctgggagggcttttagcagcactggacactttgtaggggcactcagcaggtacacatactttcacctactctgtcttaagcaagctgtgggcatagttatgagatgggttggaggttggcctttcccacattgtggggcacagtccctctcggatgctgcctcctcccaatctgactctaattagaggactttttgtacagagccttttgagttaaggggcccaggcttgggagaaatggggtagggctccagagtacccctgccagagatgtcagtgttgatgtggtagtctgggagctgctgcttggaggtgcccagctctccaggctagcagagttagttatccccttctcccaccagagcaagactttgcaggctcttggtaggtaagtcatctgtaattacctgtgattctttgaggctctgcccaaaccccatctgtgattctttgaggctctgcccaaaccctatctgtgattctttgaggctctgcctccaggctgagattcaagaatgggctcagtctaagccagatcgcacattccagagaaatcacagctggtattcatgtaatgaagaaacctggctttccctgagtgttgtgaggtatgaaccgtagatgataggagcagaatgatttgaaaggaatggacagacttcctccctggaatttatctggcctctaaaaaggtatgcaactgcaactggagacacacctgggtagagatgctgggttccccacttccaaccatgtctggtttggaacctgcctgggccctgttctcccaccaccccagctctgaggagcagtcagctggtccctttctgatcacagatacatcctcccagctctatgttttcactgtcccctccctacatacatacagaaggtgctgagcctgagccagtcaagccttttgaggaacaagaaacagacacccaatcccttaggtataaggggcttgtgtaagcaagagagaagccttctgaaatcctgggatagagaagacagtatagtaaggccttggagcagacctgtggctagaaccaggagggcctggactctgcctcagggcaagcccaggcttactcactttctcttgatgacttgctctcttctgctgctctaactccctaatggaccccttagcacaatacgccctaccctgcagcaggttccaggttggaagataattgtcctgtgtgtcttgggacccccacacctagactatgacaggaagactgtcagctctgcagacatttggcataggcatgaacacatggcgccattcacttatgctttccttctgatagaggatccatttgcagatgggagttgtggttggccttctctgagcctaacctggaatctcaatggattaggatttcttctgaaagagtaagatgaggaatggtgggtgtgctgtgtgtctaatcaagtatggcgggcaaaaaactgatgaactggcattatcttagacttagaattctgtcagataaggcttatgtttttttgggaaagcatttgtatttcctttgttttgcttgctttgtcttagtgaatttccatttgagcactccagtggggtgctcaaaagcagggcaggaagaagaccggcagagctggggtacagatgggtgctaatcctccagcacagtctaggctgcatggctgagctgggagacggtatcggaggcttctgttgtggactgaggtttactgccagtggggtttgtctcaggttgtgcctatttctgggctgatgagaagacagtagctggcccctttcccatgtcagcagcccagcctgaggttttggccatgtgtgccatattcatttttgtatcctgagtgcctagatcagtgcctggcatctgcaggtcttcagtaaatatttgtgaatgaatggtgacgggccagtgagaacagtgtctgccaaggagccttactacaggaagaacactgtctacctaggagactgtctcctctgactgctctttctctggcaggtgcagactgacaagggttagttttattcctcttctggctggccatctgttgtacaccttagtttgggtgttggtactctggaggatattgtgtcaaattatctttctgttattgtctctcatgtactgttgcctccttgtgggcagggactggttccccaaaacctggcactgtcctggcatatgtgttggaaggtaagatagaaacaaacagcagtctgtgaaataagaaggagtgggccagaatcttggactgacagaccattggaacccgagctgactgtaccccactgcgattccgccttctcatggtacaggtggttgctgggagttgagaggatgggctctctccgcagggcacgtgacttcccagagcagggaccagaattgagcacacatcactggctgcacgctctttgttctttctgctgtttgtcctttttagcttctgtgtgctaggccaggattttgatatgtttgattatctgcatatgtgtgtacatgcctatgtgtctcctcacctaaattagtctttttcactttgttgatccagtgattgtcattgaatgcctttcagacacttccctctgtgaccatgaaactctgggtgtctgcattgctgatggcctggtttggtgtcctgagctgtgtgcaggccgaattcttcacctctattggtacgtgccaacaggactgtcgtctccctgacaccttggctcacatgccacggatgtctctggctgcagcctgttctcatttagagtgggatagccttaactactggttttggccagttctgaggagagtggaactggcagagttgctgttttcccctataagatcccaatgatctggatgttcagggagccagatgtctgaattgggtctttcttcctgggaagtgcaggctgcacttgggctctctggtctttttgaccaccttgcccatggaccagagagtggttctgagcagcaaatcctttgtatcctgaggatcaagcttttcctatccttccgacctaaagttcagagctttttatcctgtggtgagcccccaggatatccatgccccagtgtcatgaccagctatgtaacagtcggagaatgagatttagggctgcttcttgagtgacatccagtgcacttatctcaaacatccccttggtgcctctgcctctttcttcctgaagttgcgagatagagccccatgagtgcctaggccccctttaactccaagtccccataatcctcagagagctgacatgttcttatcccaggggacttgcttctgtgctggtattctgtgccccaaggaaggaggctggacatccctcatctgtttctcactggtgtctttcttctctcccttgcagggcacatgactgacctgatttatgcagagaaagagctggtgcagtctctgaaagagtacatccttgtggaggaagccaagctttccaagattaagaggtgtcctaagtccccaaccatccttagttggccttccttcccttctgcccctcaaggaacaaggaagccatccagggtgcctataagaggaaacctttgagagggtgatgtggggctggcctggttacttcatgccagtgcttgagaggagctaagtacatgggctaaggagtcactgtttattttctatttaagaccttttcccttacattgggggtcccagctgttatctagattaaggggctagaagtatctgtggggagttactgtattcatttttcattgcctcttgatgaaaagggccccagaacctggcaccagggaattctcactaggaaaattgtcacaggtcaagacctatgtgggtggacgcattagtcttccttttcctctggttccacagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggtgagggacggtgagcaggtgcttgagtgagcccatatgtttgtgtgctcatgcctgggttgttgtgtctgagcctgtcttgggtctgggtgttggtgggcaagtacattgtggaaacaggaccctgctggtctcatggctctctcccttctctgtggggacctggaagttggctggccttggtttttaacatgtaatgatgttcagttctttttttagcgtcttttttttagtgtctgtcttttcttattttttgctaatgacatttttccaattatactttagtgatacatgtttatagaaaagtcggaaaacacaaaaacaagagaattataattcttaatccagttgcccagtggtgagcattattaaaattgtagtttttctacctatgcatatacatttaaaaaatggaactatacatacataccagggcatgcaaactcagttgcttggagggacaatgaatttacaagtgtcaagtgggctggatggtggggccagggcaagttggggagcataggtctgatctaaattcattcctattcatatgttttacaaacaaagcatatctgttggtagatttgtgacagaagaaaaaattctgtgaatttctcagcttctttatatgccattcaatgttcttctgcaacatgattttaatggctggatggtgattacctgtcagatggtgataatctgtcatactgataatactgtcaaatgggtcaagtcattggatatgggattttttctgaattatcagcacctttttacatatttcttggtgtatacttctgattacttttttagggtaagttcctagaagtgatattaccgatgagagtgtgaactttttaaaagctttaaactatacttggtgcttttattgtgataatactttttatgccctaatacttttctgtcaataagaagagatggtacggtgggcctggaggtgggctctcctaactcctagccctgggtttagtcccctggactcactgactttttttttttttttttttttttttgagactgagtctcactctgtcaccaggctggagtgtagtggcgggatctcggctcactgcaacctctgcctccgggttcaagcaattcttctgcctcagcctcctgactagctgggactataggcacatgccaccatgcccagctaatttttttttggtatttttagtagagacagggtttcaccatgttggctaggatgttcttgatctcttgacctcgtgatccacccatctccacctcccaaagtgctgggattacaggtgtgagccaccatgcccgctgcctttttttttttttttttttttttttttaaagggacagggtctcactatattagcctagactggagtgcagtggctattcacaggtgcgattgtagcacactgcaaccttggactcctggcctcacgtgatcctcctgcctcagcctcctgagtagctgggactataggcacagtgccattgtacccagctcttcactgcctcttttccctgagctgtgagtgctgattaacttcagactagctgtctctctggctgagacattttagcccatgtggccagactgggttgggcctgggggcagggtggcctctggagagggattggtgagctcagccaggctggagctgtgcccagtgagctcactgcctccagaaaccacggctgcctttcccagactcccgcctctccgcctgggcctgcagctcgggacaggctgttctgcctgcacggcaggagactaagcctacccagatgacctcctctctccaatcttgttctccacaccctacactcccaccatcatctggttcctttggaaaaccttatgattacctggaaggagatagggcaggcccagagaataattggttgttttcatctctgactttgagttcttgcccctgaaacgagcagggcatgctgacagtgtggcttttcctggcagcatgttcccctactcccaccccaccagattctaaactctttagagtccctgaccatgtagctatgaagacaaggaaggcagggttacagcttcttggtccctgtccccagttatggctgaagtggatgtttaggtctgaagtcataggtggcagtggatacagctactcttgggaagaggttggggaaggaatggccttgttgttcccctctcacttctcagcttagaggcagaattgaaggccctaagtcagcctgggaaggcttggctcccacctgggattgtaggaggtacacatcttactttacagctagggcttggagtcccagaaaagcctccttggagtacttctgtggtcaaaagctctcccacgcttcaggctgtggtcttgagcaccataactggagagcccatgccctgaactcattgaaggtctgagtggtgggagtacagaggagaacaggcccaccgtggtctcttaggggacggaccttgctgggttggtgcaaccccaccttggtccttggcctgtctaggtggtccttcagctgtcaacctagggggagggggatgacttccaggactttcatcatcacctttctggatgataagtgccagtggtcagtaatgagtggccagctcggcttcattagttaactgtcattgtcccttggactcctcaacttgaaatgtgtgctggaagtctgtgtttacctgactagcccaattaccctggatcaaggttttccatgggatttattttccactgagtggttgacagttcttcctgagtcctctcccgtgctcttctcagttaccctctctatcctctgtttcttctgtctccaccagctctgactgaatgatttggagccaagacttctggactcctaaatattaaccaatatggggggctgcttctacttagttccaaagagcaacacaggcagtaggtatggtgaggagtaagaaaggaaaagtccccatagactggagtcatcagggacaacttcctggtggaagggggcaacagcctttgagggagggggcggggaaatttcactagccagagaccctctttgtggctgcctctctggtcccaagtggaattctgcccctggatcaagggtaatctcttgttctgactctcatttggaaggttttatcgccaacctctctgtgcagcggcagttcttccccactgatgaggacgagataggagctgccaaagccctgatgagacttcaggacacatacaggctggacccaggcacaatttccagaggggaacttccaggtaactcaccactccaggcgttgcctgtcccgcatgtgtctctttagtggcgggacaggttggagccaccaccaacttgtggcctttaacctcgggtgcacctctggtgcacctcttggctcaccagtttgtgctggactccctctcccatgacaggtttctccctcagcccctgccctgccacctccctccatgtattagccaaggccctctcctcttgcatctcagagaaagccaaagttgctgctcaggaaccccctccacgtctgtccccagagcaccacacagatctgcattcagacctgcttcttgtctcccaccctccaatgtcttttcatctaaggctgatctgggcttactatccccctgtcttgagtcctcttagttacagtctctgctcctatacattctgtctccacctctctgggttctacccttgagctcccatataggctctattcttgctcatcttaacacttgcctccctcggtatctgagagtctttcgagtctttgctgctgattcatctcttctcccctcctggttaggctactggatagagtaatctacactctgtccattttcctggttcccatatactcctgaactcacagtatctggcctttttccccactgtcactgatgctgttcttacaaggtcatcagtggccgcttggctggtaaacccagcgaacaaggttcacacataatgttctttaacttcccagcagcatttgacagatagattgcctcattctttgtgatgttctctcctcctttgaattctggcatactgatatctgcttctcttttagcctctctggtcattttctctcaagtggcccctctcccactgacttcccagtgttagtgtttataagaagatgttttgagggctgctggagacaagtaaccccagcgattcactgtgtgaggctcatgcagacccagcttattccagctccagaacctcagctgccccctttagactccattagagagagggcagttcagggcacctgcaagatctgttcactctgtagccttgagattggttgcttggaggagggaaccataccctggcgttgacctctcacgttcactcagcaaacccatgagtgtcctgaatagggttatggggcagaaaggaattactccctaggactccatccttacctcatcttctccctgagcaccttccccaggtgagcacagccatttccatcacctgaggtggatgacatccagatctgtgtttcttgccaaggcttgtctcccgagcttctaaccagtgtagacggatgcctttgggacatctgtacttgaatgtcccatggacttctcgaacttcatgtgtcctgaactgaaatcctcatctccttgtaaacactttaccttccccctcatccttctatctcagcaaaaaggacctccatcctctggctgcctaagccagaagcctaaggcctatggattctacctccttctctcatgtcttccgtgcttatcccctgactccagcctcacagctacttttttctcaatttgattatcaaaataccattctgacttgtctcctacctccagcttactgcttaagaccatcctccatgtggtcttaagcacacatttgttcacatgagttcctgattactgtgcttaatttccaaagctaaacccaaactcctcctgtgtgtggtctttggggtcctgcatgactccattttcctggcttccttgcccattgtactcagctttccctatcactcagctcttttgtctcaacccctctataggaatacctttacccatgtcagctaggctactccatgtctgattgcctatcagcactcagctcagctgtcactctcccaaatgctctccagggagtagacattcgagttggctctggggaggatgctgagtgccagggagccattcttagcattcttggcatctgggagacatgttgataatagctactggtcattagcatcctggggagcataggagacatcttcatatgtcatcttattgaattcttgccacaagctctttaaaattgatgatattatctttatttagagataaggggactgagacttagatatggtaacttgtctatagtcacacagctggttggcgccctagtgaggccaacacaaacctagtttagttcagctccagagccccagctcagtcagctatgttactctgccccagcaatgtaggttcctgggcctgcagagccagaggagacctgtggagaaggaaaaggggctccaggagccccccagtccctggcctacctagggacttcatcttgtgtttactgtccccaacttcctattcctcgttattggttcctgagccaccggggttagcagaccctggtctctgaagcatttagcctactgtgtagtggtttcattccaggcagaaagagccttctctgagttcttttgtgtcagccatgcccaggttgctgttaatggggctgtggggagtcttccttgctttccagggagagtcacagcccccacttcccctccatggtatctgctttctcattattctctgaggaaccacacacatagtctttcccatcttgagctcaccctaaatcctgcatctccctatagctgcttcttcatattggcttgaaactatcttcatggtcactttccagcactccctctacagcagatgacctttggtcataagacccactgaactgatactcagcaaggtccctgccacttaacagccaaagctggcactgcaaccttggctcttggcctcccttggtgtctctcacaccactcccgctccctctgtttctcctatctttagttcattctcagggttattcattgtctgttctttctgggtaggtgctccctggagctctggccttagtcatcttctccattctttcctcagagttcctgcaagctattttcctcacccatggcttggttgccacctaaatttatgttttttatattcagctaatttttccatcctctagactcatatggcaaactgcccaccagacatcttcttctctgtggtccacaggaccttcccactgtcctcaacaatgcttcctggtgggtttctggggctccccctaaaaaggccccttcccacttgggagatggggaatctgaggctaagaggtggctgtgaaccccagtccagggcagggctgggccatctgtctgtgctcactgtgtcagtggccctttaggatatgcagtctaaatgtccgatggagttctgcttggtgatgccccctatccagtggctcaggctttccttgaagtgggaatctctttccctaatccagaggctctttggagcctgacaatttacttcccctgctgtaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttggtaaggagattctaggggaaggtaagatgggaatggagagtggcagaggaactgcactgtgctggcatctgcctgacccctctcctgggactgagtcagtttaccctgtcacttggccagtgactaatgccttactgactttaggaccagtccagcttcttactagctccttacccacctcaatcctggccttaggtttgcgcagtcgctgatagatacgctcaggcctgtggcacttgtgggcctttttaataaggactctgttatggtgtatctgtcaccatgcaggactacacagggtggaacctttactacatcaggagcagctcaggagtcaggttgtactttaggattgttacagtgacaaacagtagcggtgctattagaggcctgaggtctaatagtaggacttcatatggcattgatactttgtgtgccttgtgctgttggactgaagaaggccaaaagcactgtgcctttaaaactcatctacctttttttttttttttttttgagacagagtctcactcatccagcctggagagcagtggcacgatctcagctcactgtaacctccgcctcccgggttgatgagattttcctgcctcagcctcccaggtggctgggattacagaggcacatgccccatgttgtattttctttagtagagatgaggttttaccatgttggtcaggctggtctcgaactcgtgacctcacgtgatccacccgcctcggcctcccaaagtgctgggattgcaggtatgagccaccgcacctggcctctgttggttttccagttacgaccagcgtactctggttagatgctgtggaaggtagaatgcagcatgcaggtgagctgctgggagagaaacccttacagaataatttctctaaatgacctaacagatgtttgtggtttccttttccttctcattccttgcattttctagacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactggtgagatgtgtgagggggctagggtgccaaagctgtggacctggactctggctctgggcaggcagatttggggaaggtgttctttattctgtaggtacttttctcagtatatcccccagtttttcatggcatctcctgaggctgacatgtggatattctctgaggtgtaggaaaggagactctctcccctcgtgccccaggtagagtgttgctcctctaagttaccagtgagctcgcctccttaccccaatatgtcccactttttgcttcactcactgttgggaagaaaacaatgggtggacgtacctcaggccccaaaagaagtcatggtataagtggagagtaagtctctgtggtaaagacaccagcgtgtactagagcttggtatcgagcctttgagagccctgggatcctagtgcttcctgaggaggcccaggtgtgacaggctctgagccttttccatgcccctgtctgcatggcttctactggctcctccaccaagaaaggtttctcccctgtcccagcccttcagacctactcaagtcttcacgaaaagggtcaggaattactttctgccatgggacttgaggatgtgaggtgattttgggagagaagaaaaattgcatgatttgtggggtgttatttcatgccagttaagctgaaggggctctcctctcctctcccctccccccattcccccctctcctcccctccccccctcccctccccctcccctccccctcccctcccccttctcctcctctctcctcccctccctccctcccttcctttcttccttcctttttcttctctttttcctgtttcctctttttccttttcttttctttctttcgtctcaccctgtcgcccaggctggtgtgcagtggtataatcatagctcactgcagctttgacctcccagccttgagcaatcctcctgcctcagtctcctgagtagctgggactacaggtatgcaccatcatgcctggctaattttttagagacaggtctatgtcatctaggctggtcccaaactcctggtctcaagctatcctttggccccccagagttctcggattacaggcatgagccactgtgcatgcccacctgctgggacttttgttttcttctgtggtgtggtgggagggagcagctgctggccatgaggtgagtccagtgtctgcagacagccagactgggaccgaggattaggactcactcagctcagggcctgttactctgtgctttccagacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaagtaggtgtcactgtaggtccttctcgggtcactgaagggggaaggtcctttttctcatccctagcactatgggtggttggtttgcccatctagccaccctttatccatatctagcatgggcctaccgtggggatacagagatgcttcagactcagcctgaccttgtgagttcatggtccagtggaagaagaacagggtaaccaatgtggacagccaagtgctatcatagaaggtcacgctgggaacagggcaggtctacactggtgtgtcagttcacctggttgggagactggtgcgtgggtgagttttttggaaatgttccataggatgctatgaagctgggtcctgtggagctcctgattaggactgtaaatgaggtgaatgacttagaggagaatgtatatctttataatattgggtcttctcatccaagggcatgacaggtctctccatatctttttaagttttcttcatataagccttgaacatttcttaagtttattccttggtagtttctttgttactgttaatttactttatttcttcattattatttttaactggttacattattttattagtttactattatatgccaaactattgattttacaaatacatttcatagtaagagctaatgtttactgaattcttaactgtggcaggaacttctaagtgcttaacatatatattaagtgttatgtcacagttatgaacagctgctcataatgatgtcactgtctctgttttacctatgaaaaagcaaactcatacagattgcagctagtggttgaatttacttatttcttttttggtttttagctgatttctctttggttgcctggatagcattaacacctggaaataaggaaaattttattttctcctgatacttgtagttcctttgtttttataaccttattgaattgcccagaacttctagagcataattacgtagaataggcatccttgtctcattcctgaatttcctggaaattcctatggtattttactgctaagaatgcagttggctgttggttttgtatatatgccatgttttaaaattattcttctgtttctagttcataaaagatttgttccccatttgacatctttcaaagagacctatttgctgccatatcccatcactgatgattgggagggaggatttagctcgattctctattgctctgctcctaatagaattgtaggggccgaggtgaccaggaggcccgacactcatggagagacctgaaataggttcctatcctggcccctggacctcatcttggaacagctttggcttgaggtactaggacatctagggctttgagtcagtggttggcatcatcgatgtggctgaggaagggggctagccagatatatggagaatggggactaggactcccctttctactcagctccagagtcctccaggaaagaaaactactttgttggttgtgccaggatttcctgagagatttcttacccgttcttcagttccagacactgagaacatttctctgtgcatgtgtgcatatgtgtacacatgtgtgtggctggccagagggtagtgttaggaaaagatatatttgaatagaagccatgcaaagagccaaacaaggttggcaaacatgtttggctcttaacatggcttctattcaaagataagctgacccctcctttccggagactgtgagggacagatgctattctggctttgaagtagagccaatgagcttaacttggcctgtggggaatgcctggcagctgtctgtggggtctctggcctgctttcaaaatagccctgtgcttcccctggggcagagcacagctgctcagagcctctttgtgggtgtcaggccaatgctgaggcacagatgtttggatggggtctggctgtggctgcagttttcagggagggactgacatgagctgaagctcaggaagggccatgagtaggagcttgggagccgtctgtcctgcttgtgctggccatcttaccagatcatgccatagcagcacagtgtccaagttggtccatctcacccccttactagccttctggtccatctactcctctccatcccttctgccaccacctggcccgggccaccatcatctcttgccctgacctctgtcgtggcctcactagcctcccagtccccactctggcccctcattagtcaactctccatgaggtattcacagtgatccattttacattcacattttgagtgtccctcccctgcataaagccttccccatttctcgttggccacaaggttgcatctagttcctagcccctgcttgtctcttcagcctgttctctcttactacttcccataacctttaatccacacctactgcaacacccattttcattcccaggcctctggattgctgctctttccctgttcctgtaatgttcctctacttggataactcatgttaacccttcaggcctcagctaggtggtctcctcccctaggaagctattcttgacactataccctgagcttccacaggatggtaagttcacccatgctgtgctgcagttacctgactggttttctgctttccccacttgactgagttgtaagagtgcaggggccatgtctcagttacctagcatagtgccaggcacaaagtaggcactcatcaatatttattgaaatcaaggggaagtgtgttggggtgggagtacctgggcctatggccccacccatgtgaggtcatgaggacagtccacagctgaagcacatggacctttgccatgttggctggctctgggcggcgagtcccccttggggtttcactaagcctaactgtggaggctgggggagatgaagtagatgcagggagtgcatgtgtagtgtgtacctgtatgagtgggtggcttccaggcagtggttcacttattttaacttacagaatcttttcctggttttatcatctgacttgtaaggatcccaagggagcgaaaactgtgccatctgtctttgcttcttgaggctgtgggaacccagtgtgaggtggtgcagcaggagagtgtttggatgggtttcttggcagaggagcccactgaggttcggaaggatggtggaacttgactcaattgagagaagtacataaggcggaggctcaggcatggtggcacagtctgaaaatggtgggagtagctaagctcaggcaggctgtgctcaggcaggggtggtatgtgggcctggcaaggaaaggggctagtcaggcagatgcatgggtagacaaggcaggcataattctgcaggcaaagcggacctggggaggagaagggatgagcagtgaccgagcagggcaatagccaggaactgattgcggattgggaatgtggaggcctcagactcttgccctcaactggcctgcaggatcttggggccttggctagagccattggctgcaaagcttcctccactagcatggcagtaaatctggtcccagtgctctctgggaaaatattcaaggcaaaacaaacaaacaaacaaatcaagtcttccctctcctccttccttctagcttgcacgagccaccgttcgtgatcccaagacaggagtcctcactgtcgccagctaccgggtttccaaaaggtaagcaaagagcaggggttcgtagctgctcaagccccaacttcaggacttctcagtgcctaccctagggatgggtggcttgccttttcctgcctgctggcacctcctcacccccttgcagcaggcatcctgtactgcctgttcatgctggccctgactctggggacagagttcaggacctcatggaagcctgcccttccgtcttcttttctctgcccttttctttttgcccagctcctggctagaggaagatgatgaccctgttgtggcccgagtaaatcgtcggatgcagcatatcacagggttaacagtaaagactgcagaattgttacaggtacagatagtacctgggactgtaggagttgggaagtgggtatttgtggctagatggtctcacagggtgtccagaactgggccaagaggcccaactgtatgactactgcctgatgctatgaatatggagtgatctcattttaggaaaccagaattaatcatgcctgctggctttcaacaattagtgttcaacaaatatctattgagcatctgctgtgtgcccaagtgtgctgcaagctagggatcaggggtagttatggtaggttcgttcatgtcttcttgacaacagaagctcaaatcctgaatggtctcagggacatctctaagagagctaaaaatgacttcagaggccatggttctgtgtcataatcaaatacatttgaaggtcaaagtattctgtgtgttttctcctgctgaaccacaactgaagttgctccaaaagcagcagcaggggacttcccatgagggactgccaagatggggtcagttgagaattcaaagaaagcggcactaaacccctgggtcttcagtccacagcatttattagggaacttgcagagtgggctgcagcaatcctcaaaatggacagcaagagacaagaattgttttacctaagtatttccacagtgagggagtcagagtgtggagtttatttgagggtttagggaatttggttcagggctggggctagtttctttcagtgttatgggcaacaacctaaacaccttcatcagtgcctgggaatgttgaagactccagcttgtgttccagcctgaagggaaaaacctgcagctggctgggtcacagagctgtcaagggagtctgattttcagtcagaacaaagaaagaaaggcggggtgggtctgggggaccttacactgtgatatgtaggtggaagtgagaggcctggactggttaagctggtgcaggtggaatgttcttgtccaagtactcccactgggaccctggcttcctgcctttattcagaggtgattttgaagaaatgtggcagcaccctgctgaaaggttttgggtaaagctccttattaaagtatcctcttgggtaaagcttagtaaagtgtcctcttgggtattgagtccaaatcagcactggctatgttcccttataaatattggaacttctgtgttctgttgtaaaattgatgacctgagacaccatcagagaagtttcactggcatctttctagaggcctctgggtctctctgtttggccaaagtttctgtatacttaaagatagcagcctttacctttaggattggcatttgggtctgatctaccatagatctcattagaatattgattaaagatcatttggaaaagattttttgaacttttgcttggacacgcctaagcaaatcagccttctttttgttgttttttctgtgtagctgcatcagcaattggaaaatcaattttgaaggtcatctttatggattggtgtgaagtctaccagagttttaaaaagcatactgattaccttgcaaatagtactgtgaaattttaatttttttttcagttcagctcaacttagtgttttgtaatttttaaataaattctgcagataagcacatccatggaggacttctgcctcatctcccacttgctgcgtatgtgtaagagcaccaccatttcaagagtgataggcactcttgatgtgctagatgagtccctgttggcattgtcttgattcatatcttcttggagcaggtttttgtttttgtttttaaagacatctgccactgcttcctctgtgttagagccagtcttcaggactttcatggtcctgatcaaagaccacagtctgcttggctgatttcataccctggaccaagaggctgagtagacaggacctgtggctctgttgctttcctggctagctgtgcggctgtactcactgtatccctgtcttacactcacccgtggaagatagcagcttcttgcctatggactgacttctctgctacaattcagcctttatcttgtctggcctctcattgtgttgtagctcaattgtctggggcccgaatgccagacctcttggtagaggggctcttatagttaaggatcttctggaaattcagaccacagctgccaagtggttgagatgccatttttgtttgtattcttctcctaggaactgtctcgacatttcctttgccagtcagtggtattgaaggctttgatccttcatggtctggggaacaggaacctgggtttcagcatgtatccctaagtgcttactccatatgaaatgcttgtggtatgatacatgcctaggcaccagcaacagccctcacaccaggtcctttaggaaatgctgcaggcctctggaaaggagctggttcttctatctgttgacattctttcagctgtagctcacatgtttgctgtagatcatttgaaggaaaaaggtaattgaggctttctggtgaattggatgagggcttatctgatagagaggaagagatgctacacctctaggattctaaagattgaagactttggctgcatgatgtctcagcctcaccagaaaagtgatttctgacctttttaattttgcctttactctgtccttagcattgtaaatacccacatctttcaaataactgaccccactcttacaatagtaagtctaaagatttaagtgaatacctcctcacatgaatcggtcttgacgtacagtttcttgttattaaaggcgtgagcctggggacttgagtatgcctggatagggaatcttactgctgcaaatctagatggtcctatgcattttgtacttatttgggaactgtattaaagaaagtaggtacggtggcttcagaaccataatcaaatataattctccaaacctaaaagatgagccagctctcgcaatgcagcttctttcactgcctgggatttgtaaatttaagcaatccatttaacaagtggaagtattggaaaatgcagtcatactttgcagctccagcaacaagcactaattgaattttcctgagtgtacctgcacagcagtcacagttgtgtttaaaattttcttccatgccaggtgtcgtggcttacatctgtaactcagtacttggggagaccaaggcaggaggattgctcgaagccaggagtttgagaccagtctgggcaacatagtgagactctgtctctacccccactccccccaaaaaaaaggagagagaaaaaaattttcttcaagctcttgactacaaaaagagatatgctttctcagctgctctggcacttctctccttagatgcatctccagccttagggccacctgctgaaccaggcttccttgtgctgttgacaggatttccaggtatttttggtacaggaatcttaaaggctgaagcaatggatgacaacatgttttcatccatgctttgtattaaaatttttatttttgtagacatggaaaatgatactgccaacattttgtgctctaataagaggatttcatctcttataaagtccactgtccctttctttcttgcatttctttttttgtgtgtatgtgaaacagggtctcactctgttgcccaggctggagtgcagtggcacagtcatagctcagtgcaaccttgaactcctgtgctcaagcaatcctcctgcctcagcttcctgagtagctgggactacaggtgcacgccactgtgcccagctaattttttcattagtagagacagatggggtcttgctatgttgcccaggctggtctcaaacttctgagctcaagcagtcctctcacttcagcctcccaaagtgctgggattacaggcgtgagccaacacgcctggcttctgtcccacgtttttataggtctctgttattgctagttttgtagcatctctcacctgactgttgggattgcagaaaaggatatacaaaaaataccaactttctgagaacttatggcctagccccagaggtttttatgttttcagtgagacacaatagccaactgttcccagatggacattggtggtgctacttgatccatcagcttccatgtcagattctgtgcttcatctttaaccttgtctctcattctgtctactgacgctgagacaataattgtgatttaggacttcccattgtgctgataagctgtccacaaaggcatttacaatttctaatccaatttatgacacctggtagttgctcagatgttacttcaggtccagggtcacactggggttgctgatgtagcacggtaattcttgactgcctggcagctggccacccatgttgtgctgtttcactccatgcagtagaccactgtgggagtctgccccactcagtctcaccaggaatagcagaggtggtaggaacagtgccaggtgctgagtacctccaaaactagtttaaaaaagaaaatcctcgtcttaaatttgttactcactttcctctggattactttcttaatatgtcccaaacaaactgggtccaggccagggcccgcctcaagcagtgttccctttgctgctgtctgagtgtccatgaagggctggtgcttttcctcagtgatcatatgcagttcacccatcttgttttgtttgggaaaccacatttgtgccgcagccttactcttggacagaactgtagacttgtttgtgatgtttgctctgcctgtgctgccagggcatggttgtcttccaccttagagaggctgctcttgggagttctggttgttttcaggcctgggaagatggtatccctagagtgattggctgctacagagctgttcatgctgcttacaaggtctaatgctgttatttcccacaggttgcaaattatggagtgggaggacagtatgaaccgcacttcgacttctctagggtaaggcctaaatcacaggtgctttcaaagggccctgctctagctgatttgagaagggtggagcttctaggagcatttcagcctccacatcagtacccccaccccttgtcctccctccacctctgcatcaccaggggaaactcttcgttactggtgaatcccaaatctggaaccaagggtcctgcagaatgcagtggagcctggctgtctcccctgtagatgtggggcgttcgtcccctgccctaattctgtcaccctttgccctgattctaaagcaaagagcctcactaggtctttgtgaaaactgttcttgtcccttttcctcttccccgtctactccatgccctagccagaatttactttgcagctttggcacatattccaggctgatttatggaacacacacttattacttttccctgacccttttggtcctagtcttgtgggtggtggatgaagcctgttgtaaacttgggtgaaagttgttgtctgttgcagcgaccttttgacagcggcctcaaaacagaggggaataggttagcgacgtttcttaactacgtaagtactgggtccaggcccacctgttcattctcacttaattttgtagaatgatgagcgagatactttcaagcatttagggacggggaatcgtgtggctactttcttaaactacgtgagtatgatgtgtgctgatgagccctaaggggaccctgggtccagagggctgccttatatcccacccccatcagggctgatctcatctgctgttaagtaatggtcaggtccttctggctctcagcacccttcttggctgcagtagggagagttggcctctgtttctattcattttccccactgccaccagcaggactttaacattcctggctcctatttttttccccagtgtttaaaattgtgataaaacagacataacataaaacttaccatcttaaccattttttaaatgtacggttcagtggtattaaatacattcatagtgcgcaagcatcaccaccattcatttccatctattttcatcatctaaaactgaaactctacccattaagcaataattccagattcccctcctgcagctcctggcagccaccattctgctttctgtcgctgtgattttggttacttaaataaatggaatcaaagtattaacacttgtctttttgtgtggctggtgcataatgtcctcaaggtttatccatgttgtagcatattctggcttcttcttcttctttttttttttttttttttttttggagatggagtcttgctctgtcacccagactggagtgcagtggtgggatctcggctcactgcaacctcagcctcccaggttcgagtgattctcatacctcagccttccaagcagctgggattataggcgctagccacaacgcctggctaatttttgtatttttagtagagatagggtttcaccatgttggccaggctggtctcaaactcccgacctcaggtgatccgcccccctcggcctcccaaagtgctgggattacaggcgtgagccactgcgccctgccattctggttcctttttgatgggcccagtgctagtctggacttttgggatgggtgccctggagggttccctccttggcatcagagtgaggagatagccttagctctctctagatgagagctgcctttgtgttctccaaggcttaatggcctgattcccacctcttgcctctgttttatccataggttgtagggtttatctttcacatgaggagcagtttcctctcccctctgctgagagccagctctaaagaggcatagaggcagtaaagtaacttggagacagaagcctgtgtccattttttccctttatgcttttattgtgtggttattacatgctggggattgtgctgtgtacatgctggtgagcagaacatatgtggtctctcttgtgcttgaggtccaatatgagagacttattttaaacatcagagagattcttctttatctttttttttttttttttttgagacagactctccctctgttgcccaggctggagtgcagtggcgctatctcagcttactgcaaactctgcctcccaggttcaagcgattctcctgcctcagcctcccaagtagctgggattataggcgtgcaccaccatgcccagctaatttttgtatttttagtagagatgaggtttcaccatcttggccagactggtctcaagctcctgacctcaagtgatccacccgccttggcctcccaaagtgctggcattacaggcgtgagccaccatgcccagcctaaacatcagagagattattatgtagttatggagacaggtgctgtgaaccccaggcttggggttcagtggaggcctctctttggaagtaacatatcagttgagacttaaaagttgagtggaaattagctggtagaacatggtttctggcagaagagagagtgtatgtagtcctgtaagagaaaaggaacttgggatgttggaaaggtagaaaaaggctggtgtgtctggagagaggctagtgagactgacagggccttggggttctagaaaagaatctgagtttgatccacagggctgtgagaagccatcagagcttttgtcttattcatttaccatatgtctgtcaagtacccttcagtgagtctggtatgtgtcctgtggaaatattttttacctccaatttttattaaattatggacaaaaaaagtaagagagccagatgggaaagaagtagtgctttggccatgagtcaaggcatgctctgtgggcatgagtacagccttgctagtgtggaacttgtgttcaatgtagtttaaggccttaccataggagaaagcagggcctctagagacacagtgccccacccttccactcagttggccccaggaagggtggctactctgggaaggtgaaggtctgactagagcagcaaactactagagccagagaaacagagctgcagtggggactgcacatggtgttggaaacagtacagagctcctggtcagggcactttgcagagtacagtggcttaggcaaggccaaggctagatggggattcaaagggtggggtcagaacaggcattttctgagtacagactcagattattttcatccagggacagcccggatgtgggtctcctgtgggcctcaactcttgaacactcatgacatggagactgttctaatgaatcacactggttaagtaggcatgggaagagcctttcttggctaaagggctggccatggagcagacaccaagtagtgtcactcatgctgagaggagggcaatctatataccttgtcatgtcctttgtggctcaattgctctgagagccttgggtaggagggtcaagctctatgtcttatatttccagatgagtgatgtagaagctggtggtgccaccgtcttccctgatctgggggctgcaatttggcctaagaaggtaagttctgattcttgtgggtcagaggttgaagcaaggctcagactttactttgtccatgtcccccagtaccattacctggcctgcctgattgtcactgtgatgtgccttagcccacctggggtctgacctggtagcccagcttctccctgtgaagaaaggacagggagggaagtcccttcaggggcgggtgagttcccagacttctacctcagaaaggtaggtgctttctgggaaatgtctctgttgctggagtcccagagccctatcccctgtccatgggaaaatgagggtgtttctgctcagggcagagcttctgtgatgcttgcagtcaggtccctgagcacagtctcttaagaatgtgttctgaaaggccatctctttcccagggtacagctgtgttctggtacaacctcttgcggagcggggaaggtgactaccgaacaagacatgctgcctgccctgtgcttgtgggctgcaagtggggtgagtgtcttaaggggtagtgttggtgttggtggcctcagcttgggctttgcttattggccttagattctgagctgggaggcaactgctgccaaatttgctgagactgtctcccttcttaggtttttttctgctgttattaccatccagccatgtaatgtccatgcagctggtaaatgccaaggcagctggttggaaacactcagagatacacaggaagctgaagaaggcctgaggacgaatagctgcataagcaccataggtccaggaccctctggcaaggcttctgagggagcagagtggagagctggaagcagtgaggggaaagagtgtctcaggcaaacaaggcccatatggatggaggcacaggctaaaaccagcatacgggtgtgggggctggctcccttgtcacttgaagaaagggaggcctgtggcacaggggccagaagatgaggctggaggctgggaccaaactgcagaggctcaagcttgagccttatcctgggagcagttgtggtgagcctcggagaggctcaaaccaggatatgacaggaagtgtttgtaaggagatgagtgtgtagcccccttggagagttttgaagataaatagtgataggtttgcagataattaagcaaatggaaaagaaaacaaggcagttgctgaattcaggggaaaaaaagttgtacaagaaaggaaatgtaagtataatctactagatggctcaggtgtaacacatgatataattatgtacacactgagtattactttaactaaaacttatgatttacctgtactggaaaggtgggaggggatgagtttgtgttttaggggtagaataaaagaattccaaagttgaaagtcaaggaatagaactataagcatcttatctagaaaaatgaggttaaatatcagaagaaacagctagaggagtttaatgttccctgggagtggagattagggatgggaaggagaggcttaggaggagtgctatttatcattataagccttgcgacaattttatttttttcaatgaagtacatgttattactttatattttaaaagctctgtgacttcagtagtgcattgaaataaaatttttattcattatgagagagtctgtgaggaacagaatcatggttcctgtgtgtttgaagatatggcgtggggtgatagtgctggcagcagctctgttgctcttgtgcccatggcatacagactggatctgctggtccacggctcctgaggttaatgtccaagccctctgcaatgctgacagtcttcctcatcctcacaccctacctctcagtttctacctgccacctcccagtaatattaggcctcttgagtccccaacacacgtcagggtggcttctgccttgattactttctcatcctgttgtcactcctgggaccctcttggtgagagaaccatctgggtatgcccatcttcttcccaggataacttctatgtagctttatattctagccctaggatttcctcttccctctaagagcaagaaacatgtgtgcaggttgccatgggaatagagccaaagggcatcaaaggtcatgggcatgaaagggcatgattagatgcccttgggtgctattcccatggcaacctgcacacatgtatcttgtcccactggcagaatttcatacaattatctgtttacatgtgtcttccttaccaattcttcagcaaattgaggcctgagatcatgtcttgtcttatttgtgtctgattccagggcacagtgcagggggtcatcatgaaggagtcattcattcaggctactaaactgaccaataggattgtaacatgcttgctttcttttcacagtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 13 - DNA, 43084 bp, homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggtgagtgcggcccgggaccttgggcctttttgcgcggtcccgggcggggagctgcggccgctgccccaggccgggtcggcgccggccagctctcgcctgaggcgcacccctcctcctcagcgtttccgcccccagcgccttaggtgcttccttcctccctccgaagtgccggcgctggctggcggcgtaaataacggtgggcgtgtggctttgaccgtattgttgaaaacaaaccagctgggccgcgggacgacctcccgcctcccggcgcacgtgtgcaggtgcgcgctaggccaggccccttccaaggagtcggacccgggtgggaggccgagcgtgggcacccccgagaatcgcgtttggattccgtgcagtgatgatgaatgcccagttttgcatatgatgattgcatagaattggcgtgataatagggaaggcagattataactggcccagggtttcttagaatgttttccttgccagtggcttaaaactgttggcaccaacagcacatttcatcatcagcaagtaagtcttgggcacgtgttgagtgcatgaggacaagatgctgtgaagtttatttaccacattatcttggttttctctagaagctgttcaacaaattgcagaaggaattgcatagttaggcattttaacttttacatcccacttcccatgtgaaggcgatgaggggaaaagggaaaaccttaatgaattcataaaatttgagtacaaaggttatcttctgcattgtgacttctgcattgaacgatacctgcatggttggcaactttgtcttaaaactgtggtttgtagtggcataatttttggctcaaagccttaggtttttgtttttactttaaaatgaccctagttcgaggaaggggcgaatttggtggtattcatgagtatgccataaaacttttacaagctgttttcctttagtaccttaatttctactgttgacaatctagtttttgctaacgttttctcttctaaagcagcaagaatagtaagtttaaaatgcattactggaataataagaccttttagtttaattttaaatggagctgtttgccaaaggacattctacaacgattctgcttagggagtgatatgggatcctgatatgggagtgtagaggggtcaggagactttcagtaaccagacaattgaataggacctacttgaagatggtgcaaacaggcagtggtgaattttgctgttgcttgaaagctttcctctgcacttactcttttttcccgtgtgtgtgtgtgtgtgtgtgtgtgtgtgtgtgtgtatttttttttaaaaatagaaatggggtctcactatgttgcccaggctggtctcaaactcctgggctcaagccatcctcccacctcggcctcccaaagtgatgataggtgtgagccaccatgcccggactgcacttaatctttgcttatggtaattagcattagtggttctatatggaatcagtgagtcttcctatgcaaacatcaaaattttcctctttcttttgagacagggttttactctgtcacccaggctggagtgcagtggtgctatcatagctcactgtaacctcaaatttcagcctgagcctcccaagcctagaactaccggcaagcaccaccacgcccggctattttttattttctgtatatgtgaggtctcattgtgttgcccaggctggtcctgaaccgctgggctcaaacagtcctcaagcctcggcctcgcaaagtgctgggattataggcgtgaaccactgtgcctggcctcctgtttttaatttatttttttaaggctggtcaagttaagcagtgggagtggagaaggaacaaagaaatctgtaaccggttgtgatcaattagttgtaaataccactgcattcggaccagcttaaagtttctgtttcttagacaggcacttactgtttttaaacctagagttagataacagattttctaaatgatagcagcaacggggtgtacaggatagacttttccaggttctgctgttaattttataaagccttgctcagacatgctcaggttacctaacttctaaaatgggtgatcactttaaggatgcaaattagggagacaagagtatcgtaattgctgtacagagccattggaatgtcagtaattggaaggtcataactctggagactgggttatctcatccctcgcctcccacaggcaggtgtatctttgcctcctattccctgccccatcgtggtgattctatccctctggccttgccggataacttcctctctatttctctcagcctcttgccttctgtttccttatggcttttacttactgctttacccatcatgtttggtttcaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtaagattctcatcttgtgtttgcaatttgatggagttgtggactttattcaaggttacagcaaatgcttttttttactctttggtggaatcttttttgttttgttttgttttgtttgagacggagtcttgctctgtcgcccaggctggagtgcagtggcgcgatcttgcctcactgcaagctccgcctcccgggttcaggcgattctcctgcctcagcctcccgagtaactgggattacaggcacgtgccaccacgcccagctaatttttgtatttttagtagagacagggtttcaccatgttggccaggatgatctcggtctcctgaactcgtgatccacccaccttggcctcccaaagtgctgggattacagacgtgagccaccgtgcccgaccagagtcttaaggtagtagcagtattctttttttggctgggggcaggtgggggcaatgtatttgggcttgtgccctgaatcgtggactccacaacttcttgattttgagaaagccagtcaaaactgcactgaaatacagatgctaaatttaggatttatgttagtatatcttcaaggatattataagaaaaaatgtctgcaatttgttgatgactgggtatttatgtatattgcctttaatcccttcaacaaccttgcacagtgggtatgattctctccattttattcattgttattatttttatttactttttgtttttgaaatggaatcttgctctgttgcccaggctggagtgcaatggcatgatcttggctcactgcaacctctgcctcctgggttcaagtgattctcctgcctcagcctccagagtagctgggattacaggcacctgccaccatgcctggctaatttttgtatttttagtagaaatagaggtttcaccatgttggccaggctggtctcaagctcctgacctcaggtgatcctcccaccttggcttcccaaagtgctgggattacaggcatgagccaccactcctggcctacttatttttttgagacaggttcttactctgtcacccaggttggagtgcagtggtgatcacagctcagctcactgcaacctccacctccctggctcaggtgatcctcccacctcggcctcctgagtagctgggaccacaagtgcatgccacacccagctaatttttgtattttttagcagagatggggtttttccatgttgcctacgctggcctcaaactccggaggtcaaggtatttgcccacctgggcctctcaaagtgcagggattatgggcatgagccattgtgtctagcctgtttattattttttaaattaatttattttctttttagagacagggtctccatcacccaggctagagtgcagtagtgtgatcatggctcactgcagtcttgacctcctggggtcaagagattctcctgctaaggcagctgcctcccgagcagctgggaccacagccatgcgccaccatacctgaccaattcttttatttttttgtagagatgggggtctcacttttttgcccaggcaggttgtgaactcctgggctcaagcagtcctctcaccttggcttcacaaagtgttggtattacagacatgagccaccgcacctggcaggttaactctgtacagatgaggatgctgaggcacataaaggttaaatcttttgcgtaagacagtaccattgatagtggagttgggattcaaacccccatttgtccatctctgctataccgtgctatagtcagaatgatgaaatatatgaaaggatatatgtatttttaataaactgtgtttattgaagggtatctttttataaattacaaaagttaaaatgtttatttttctgttttaaaacaattagaagtttttggaattgtgtagaaaaagtgtgatctcttcccaaagataagtagagatgttaagggtatacactcatggagccacctatatacagccttcattaatgttactgatttaaaagtgttgttcttttaagcactgtatgcttcaaacaaatgagttgcccagagttaagtcttaaatggaaaaggtttagctgcagggcatttcccagttatgattcatggagattcaagttttctttttgtaagcattatagcgtatgggagaagttgatctaatcgcaatttaaaaaagcaaaatatgactgctatatatatgataatcagatgctatctagtccaagtatggaatagttataagtgtggattaaatgggaagcatttgtttagtaattatgatgggatataatggagaaaatataatattccatggaagatttttcctgtttttaaaaaattcttcattagaagtagaatatgctgctttttgaagcttatcagtcatgaggtctgatcggtgcctgttgtaggtactcaaatatctcttggatggagagcgtagttgttcttgccaattaagaggaaattaagggttaaagcaaagcagcagctgctatcagaatcccttaactttggaatgcagtaagacatattgcttgtcagaaacagctttccaaaccaacagatggaattacaggtttttaaagcacttccattgctcctagatgcctgctaagttaggacagttgcagataaagtgcttacagccaagtggagcagatcccttacactgtcgaagaaagtaattcagtggtagcaagttatttttagctctggccccgcagtgccattgtacttgcctgcaagaccatcagaaaatcatttggccttctctattttgctcattccttaacagatgctttgatacttcgaattgttagataaatttaaaatgtacatttttatgacttttgtgttttttgttcagtttaaaagaaccatgtagattataggctttcaataaatacttgttagttggacataaatatgtaaaattaaggttttaaagcacagatatttaagatacagtcttagagcaagagaggctgtcctccttttactgataataagacaaattaagtcatttgcccaagatcacatagttactggtgacagatctcagcataatcagtatatatactgtaatgtacagtggtaaattaaaaaaaaattaaaagccattttagaatgtagaactcggaaaatcttaaaattcttaaatttgacctttgcttttaggagaaaatgtgcaccttctaccattcattcccagcactttgcttgaatgtgcatgggtgtaaaaattatacttcaaccataatttatagcagtattctaaattaaaaattataaaatgctaaaaatagcttttgagctaattttcatgatattgaactttcagaatataaaagaacaaacttatcctattgatctgcattttaggtatatccagagtcttcaggagcttcttgattttaaggacaaaagtgctgaggatgctaaagctatttatgagtaagttcactattttgaccctattcttaaacctattattaggtcacttgggggaaattggttaacttttaggtttctactactttagaacatgtgatatatgtgactgtagcagcccatacaggcaggacaaataacaatcagcaaatttgactaggcataagaaatgcttcgtgttcctctttaacaaaagacaaagttcaggtgtgatgatcagtggaaatgtaggtgtggcctcagtgccagttggactgttcacctggagggtgcatgctccttctaatggacaaccaccttcagccccagctgatctttgccatatgaaaatactgcccatatcatctgattgttttctgattttaaaggaaagctacaagtctagatttgtaatgtaaaatctctcacttttgaaagattggtaactaattaaaacattttttaaaacacagaaggcctagaagaacatggttgcaggtctctagtttatgctgtatggcctgcaagatgatgtaagtaatatgacaatgttaataacccatataccagaattggtaaaccaaagtatttgccttatgcagctacctgcttattgcagtgaagggtactgagagtgtaatgaccatctcttgtcctcagttagttacacatgttttttggactgtctttaaagtgaacagtaacacttcatttttttaaacatgattttaatctgaaaataacttcagcaagagtttactccttgcttaggtattgagcagactttacatgaatgatgttttttaatctttaaaacaattcattgaaataatgctgtttgtgcacaaagagggtaagtagtttaaggttacatagttagcaaatggtagaatccaagcagtcttactttaaaagtaaacattatgttatagagccttctgaaaacagtcattcagagctgtggaaaataagtagtcaagcagaataatacagatttgtgtttctttgaagcagaaagaaaataataaaggagtgactagaatgatgagttgtttgttgtttttgaagagttttgttgtttgtattttagtttaacagtcttgttttgaagcgcattactaactaggaattccaaaaatgttttaagcagtggaaacatcattggaataagttaatagtactcaggatgatgactttgaataggaaagcactcatttggaagtgtaaattcagatgggttatgttagaaaattggtttcgttactgcataattaagacttcttgggccgggcacggtggctcacgcctgtaatcccagcactttgggaggccgaggcgggcggatcgtctgaggtcgggagttcgagaccagcctgaccaacatggagaaaccctgtctctactaaaaatacaaaattagccaggcatcatggtacatgcctataatcccggctactcaggaaggctgaggcagtagaatcacttgaactcgggaggtggaggttgcagtgagccgagattgcgccattgctctccagcctgggcaacaagagcaaaattccatctcaaaaaaaaaaaagacttattttctcttttatttagttatttaaccatgcagtgtcttctaagtgacagagatgggaagactagatgatttgaagatttgtcttttaatataattgtttacttttcctctcccattttataaactcataggatgagtgaaatgagaattcttttctgtttttctgtcctaagtgtttccttctctctttgaaccctagggaataggtccaaaacaggcaggctttattggctcattcatcttgattccttgcagagcagagcaggtgttctctagaggcaagtgctttgtctcctcctatgcagaatgtctctggaataccatcctcttagccagtgctcagatgaccttagttgataacagttaaaaccattaacattttttggattacgttttgtggcagccttactcttaggaagccaagaaaagaattaaatcttgaaagttttattttggaggtctgtatactttcatagatttggtatattttatgatctgaaatacatttaaataagtataggaaaacatgaaccgattttccttttattaaattggggattttttgtctagcatagttggttaagcttatatttttgtattaagtttacttgtcaaaatatttggctgttttgacagatgggtttgtttagctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactgtaagtgtccctcatgagtcaagagaagaagctaaatgagatgtgttggcatattttaaatttatttaggaaagttccatttaggtaggaaatttagttttaccttttggctaattaagaaaaataaatagactgccatcaagaaaggtgtttttattgaatgtaaaatactatgtttatcctaaaggaaaatatttgttctgtttggtacaatttaaacagtattcagatttggaaaagagcattaggtggtttagcttattttgttggtttttttcctttttggatagctttattgtttggtggaaaaggcaaaggaagtccatctcatcgaaaacacattggaagcataaatccaaactgcaatgtacttgaagttattaaaggtaaatactgacatttctccttgcaaaaaaagatacaaaaatcaaaattattgttatttcttactattaaaacatctatttgtatcatgagataaaatggtaggcacaaatgcatgggtttgaaaataaccttatagtattatttgtgcattatgtataggatgactattttattgatagaattatttgttaggcaaagtttggtgatactatagaggatatcttttttgttttgttttgttttgtttgagacagagtctcactctgttgcccaggctggagtgcagtggtgtgatctcagctcactgcagcctctgcctcctgagttcaagcgattgtcttgcctcagcctccccagtagccgggattacagatgctcaacactacgcctggctaatttttgtatctttagtgcaggcagggttttaccatgttggccaggctggtctggaactcctgcctgcctgcctgcctgcctcggcctcccaaagagctgggattacaggcgtgagccaccgagcccagctgagggtatctttcacttaaaaaagaattgaagtccctactgccctgtttctaattcttacactatgagcagtaattcataacaatttggtttgaatcatttcacacttttttctatttataccacttgtacacatacacaattgatgttggtcttacattgttgtttttagaaaatggggtgctctatgtttttttctacaagtttacagacatcttgctgttcagtacatctggatatgctccaaggttttgaatggctctatggaatgtatcagtatgtgttaattaattctcctgttcatgcacacttaggttgttttaatttttttctgttaccaccaataccagcagtactgctgtgaacatccttaaatacacgctcacttttgctagtattttagaggtgagattcctagaattaaaaacatttaaatgcatataaaattttggtatctccaaaaaggtttcaaacaatggataagagtgtttcctaaccaactcttaagttttgttacatagatagcaattattttctccagcctgttatttttcttttttacattgttggtgtctttttagcatatagacttttacattttttttgtagttatatttgtcattcattgtttatggctattcagctttgtcatgtcacacttagactttccctgggccaggcacagtggctcatgcctataatcccagcactttggaaggctgaagcgggtggatcacctgaggtcaggagttcgagaccagcctggccaacatggtgaaaccccctctgtactgaaaatacaaaaattagctgggcgtggtgacccatgcctacgtagtcccagctacttgggaggctgaggcaggagaatcgcttgaaccagggaggtggaggctgcagtgagccgagatagcgccactgcactccagcctggttgatcgagactccgtctcaaaggaaaaaaaaaaaggaaaggctttccctggttgggggcagtggttcatgcctgtaatcctagcaccaaggcaggaggatggcttgagcctgggagttggagacaaacctgagcaatatagggagaccatgtctctaccaaaaaaaaaaaaaaaaaaagcagactttcaccaaactatcaaagtatattttcttctgtagagagttcaagactttgatttgtcaataccattgccatcttaatgcgtgaaagagaagtatatttattaaatccttttttgttttgttttgattcacactagatggctatgaaaatgctaggcgtctgtgtgatttgtattatattaactctcccgaactagaacttgaagaactaaatggtaagcctgatgttgtctttttctcaataattagtgctttgattacttgataagggataagaatttaaatgttttaatggaagatgactttttatcaacttcgttggatatgaaggctaaaggatagtaatcatgtaaaaaatatatctataaacatatgtaatttagtcagattctttatgaaaagatttggctttttgtatcacattttctttatttttaattgataactttgattctttgcttattttttattttctgtttagtcatagaaagaaaatgataccaagaaagttacatttgacttttacatgcacttcactaatgtaagacttaccctttttctacttcctgagttgtaaataattttctgttgttgaggacatagactggggttataaaagaggaaagaaagatgctcatctatttgagaatctgtttgtctctgatggttttctttttaccctgattagtgccttttggacaaaaagggtttagatgccttgaagagggattgatgagtctctttttcctgaaagcatggtagtttgacagaaaaaagcatttcctaagatgacactttaagaaggtgtgggaagaataaaacaaaataggcttttactaagctgtattctggaccttagagtgagagagcagtgaagttatgcaattgaaaatagcattgcttggtgattttctaaagccatattaactcttttgagccatgatggtagcatagcatttggtaaataacaatcacagtgtacaagtaagtgatagtttgcaaacctgaactgctgtgagcaatttccagatgtcccatttttgttcccaagggggagtttattcagaggaaggtctgatttattggttgaattagaattctaagatatcatgagtcttaatcatttgttctactaaatgtctgttttatacacacccctatcaccacccccagtggggctcctattaagtgtttaaatgtagaattaattactgtctcgagaaattgatgctagctcatattttttattcagctttatatccatcgaaatgcctgaaataaaacaatattccacccaggtgaaacattttgaaaatggcttaaagaatgtatgggctgggcgcagtggctcacatctataatcccagcactttgggaggccgaggcgggtggctcacaaggtcaggagttcgagacaagcctggccaatatggtgaaacccgtctctactaaaagaaaaatcagccaggcgtggtggttggcgcctgtaatcccagctactcgggaggctgaggcaggagaattgcttgaacctgggaagtggaggttgcagtgagccaagatcgcgccactgcactccagtctgggcaacagagcaagactccgtctcaaaaaaaaaaaaaaaaaaaaaaagaagaagaagaatgtatgcatgcatgtgaattggactgtggaatttaaagattttaacacttctctatttggaaagtaaaattcctacccgaaagttaagcgatcttaaaaaagactttaccatcctagagaaaaatgggcgcatgggttggttcgattgtgatgcaagattgtgagaagtgaccacaggactcttgtcatcatcagttgtaaatatttgtgggtatgggttcaaacactaatacattgaagaaatggtgtggcagttctcccccaggtaatactgtcctccgtagttaatgttttcttttcatcactacacagtttattcttaaaaatgctttaagcacatctctctgtactttcatatttttctcttctgctctgtagcaaaatcaccaggacagccaatacaagtggtttatgtaccatcccatctctatcacatggtgtttgaacttttcaaggtttgtaaaatagtattacataacctttaccagtacttttctgaggttaggaatctgctctgaaagccaaatattccactaggttctcctattaagaagtgccatttcacatcagtatcatatcacattgctggagatcagctttttatcaacacagggagacatctccatgtagtggtgagctcagactatggagtcagaaagacctgggtttgaatcccaattatggctcttaatatgtgtgtgaccttgggcaagtcactcaacctctctgagcctcagtttccttttctgtaaaacaagaatactgtccaggattgtttatgactattgggaataacatactaagtgtccagtacagtggcaacgtattacatataggtgctcaatagagttatctttatgtttttataaaacaatatttagaagagtgattctcaacttgctaccctcaaaggaccagaattctttttttggtctggcttttcttgggagggggaggtcatttatattgacttacagggtttctgctgtaatctttgctctttacaacaaaatttgaaaacaaattatgctactaatattgagagtatcttttttccccgccaataatacttgctggttgacaagaaaatgggtgaggagtgaggggcacaggtcctggtgggtgaaaatgattgccctctatcagaagcttgtagtctctcttcagttgtgtttcatcagccagcagcaaactagaggaaagagggggtggctttcaatctgataatgtaaaggaaaagtgcactgaaacacagaaaaactgaccgaatatcttagaacagcagcagaatgttctttcttccaagacagcaaaaatgtatttaataccttacaaaatcttttttaaaatatttattttattttttgtagagttgaggtctcactctgttacccaggctgtccttgaactcctggcctcaagcagtcctgccccagagtgttgggattacaggcataaaccactgcacctagccctaaaatctttttatccaagtagttaaacaagtagtgatgggcacttcaagcattaacacgaattttttccttgaaattccagtggcataaagatcttgtgccctatgattgaggcactccgtattatattgtacataatgtcagtaataatggctttcacctggaacctaatcttaacctgcctttggtggaaatgatggaatctcctccataagaggactcaatcgcaattgctgtgccagggccacacactcttacttccaaattcggatgcctttttagttacatctagtttatatcattttctactgcaatgctgaatgtcatgatattgtttaaggcttctgatatgttggcactgtgtaccctatttcctttagaaattagtcaaagcagctttacaatgacaatacccttaatttcaaactagagataaagggattcattgctccatcaaatacgaccatcgctgttactactatatgaaaaaaattgctttcctttaaagaaatttatgacagttttttaaatagttctaaaaatatagctgaaactacattttcaaaaatgttttgcccatcatttactaaaattataaaagtgtttgaacagagttttctgctttaatgtaactagttaaaagtgttttgaagtctgactttggaaaataagcaaaatttagttggagtctttaggtcagaatatccttcaaatcccccccaaattgactccattaaaaaaaaaactttaaatgtggttataagaattgtgattctttggcatatttccatcaaattttaaaacttcaaatagtgcatatgtacttgaaaattacactttctcttttctaaaaagctgtatttttaatacaaccctaatgtatttcagaatgcaatgagagccactatggaacaccatgccaacagaggtgtttacccccctattcaagttcatgtcacgctgggtaatgaggatttgactgtgaaggtaaatgtgtttaatggtttgttttcttttttttttttttgtaattgatgaacagacatgcaaaggtaaccatacgcataatttctaaaagacataatctactctcaggggaaaagaatcttgtctgtaatagataataagcacattgcttcattgagctggtggattatagttatcccttgagtcttttctatgcaggtcccccgtcgaggtgattcaagttaaaataaatcttggagacagacaatttatcattaatatctctttgataagtaagatctaaaatatttgggtagttgcagtattatggagatagtattttatatataatttaaaaaattttaaaacagtgctttctaatctactggtttcatttgattctcatgacgtaggtaattttatcctcacttttacaggtgtggagactaagacacagtgattagctcaggatcacacagggcagaaatgctatgggacatgatatccagtcttctgtccccagtgctaggccttttctattacattgttcaggtggcccagtttcttcttttacattttattaaaaattgttttctgtcacccaggctggagtgcagtggtgtgatcatcactcactgtgaccttgaactcctgggctcaagcaatcctcctcccatggcttccagagtaactgggactgcaggctgcaggcatgcaagcctggctaattaaaagaattttttggtgggtagagactaggtctcactttgttgcccaggctgatctcaaaacacctggcctcaagtgatcctcccaccttggcctcccaaagcactagtattacaggtgtgagccactgtgcatggctccagtttaagagtatgatagtgtttttcttttttaataatcatttaaaaatttatattaaagtaataaatgcagagactataaaaattcaaatgtgtcagttcctggccctttgtaggcctcattactcagagattcttagtctttctttacttttttttttttttttttttttttttgagatggagtcttgctctgttgccccagggtggaatgcggtagtgtgatctcgcccactgcaacctctgcctcctgagttcaagtgattcacctgcctcagcctcccgagtagctgggataacaggcacccgccaccacgcctagctaattttttgtattttagtagagacagggtttcaccatattggccaggctggtctcgaactcgacctcgtgttatccgcctgcctcggcctcccgaagtgctgggattacaggcatgagctactgcacctggcctaatgtttacattttaaacagtaaatattacctttctgttatagtagttgaggagttagctctctttaatagagcacctgctcccctcccctcccctagcccaagggccagtttccctatactattatcccaatatttaagtttgtatatgaaattcgaagctgagaataatcatcctgcaaaattttgaaggcatccattgttccttttttaaaaaaggtacaattcagtggaattcataaggttattcaagtattgccgctgtctcattttagaacattttcatcagtcctaagaaaaaacccaagtactccgtcaggcacagcagctcatgcctgtaatcccagcactttgggaggccaagttgggcagattgcctgaggtaaggcgtttaagaccagcctggccaacatggtgaaaccccatctctacaaaaaatacaaaaaattagctgggtgtggtggcaggcgcctgtaatcccagctattcaggaggctgaggcacgagaatcgcttgaacccagcagcagagggtgcggtgagccaagattgcaccactgcactccagcctgggtgacagattgagactccatctgaaaaaaagaaaaaaaggaaaatacgcagtacctatgaagtcacttcccgtttttctctcttctagcccttggcaaccactgatctattttctgtttgtgtatttctctttctgggcattttatataaatttaatcatgcagtatgtggtcttttgttactgacttctttcacttagtataatgttatagtatgcatttgtacttcattcctttttatgaccaaatgatattctgttatatggatataacacctttgggttatccattcatcagttgatagacatttggtttgtttctattttttggttattataaataatatggctatgaatgtttgtgtacaaattattgtgtgaacatgtgtttcagttatcttatgtatatacctaggaattgaattgctgaatcataggaaactctgtttaacttgagaaactgccaaactgttttccaaaggacctgcaccattttgcattgtcatcaacaatgtgtgaaggttcctgttttacctcgtccttgtcaacaattgtagtctgtcttttttattatagacattattgtgagtgtgaagtggtatctcagtgtggtttttatttgcatttgtctaatgactatgatgttgagcatcttttcatttgctgatcggccatttgtgtatctttgaagaaatgtagattaagatccttttttcagttttaaaattggctgtcttttattgttgagttgtaacggttctctctcatgtatatgtgtatatatatatagggattctatgtgtgtgtatatatatacacacacatacatatacatatatacatacatatgtgtatatatacgcatatatacatatatgtgtgtgtatatatatacaccctatatatattctatttgtgtgtatatattctatgtgtgtgtatatatatatacactctctctagatatatatatatgtatataggggttactagtccctgatgagatgtatgatttgcaagtatattctcccattccgtgggttcttttcactttcttgatagtatcctttgaagtacaaagttgtgtttttttgttttttgcttttttaaatagagatggggtcttgctatgttgcccaggctggtcttgaactcctgaacttaagcagtcctcccaccttggcctcccacagtgctgggattacaggtgtgagtcaccacacccagccaaagtttttagttttgaaaattttcaatttttttttcacattgcatgtgatttcagttttatgtctaagaaaccattgcctactccaaagtcttgacgacttatgcctatgtttctaagagttttatagttttagcttttatatttaggtcttcgatccattttgagttaagttttgtacatggtttgaggtagaggttcatcttcattcttttgcatgtggatatccagttgtcccagtactatttgtgaaaaacctattctttccccattcaattgccctgtcacccttgtcaaaaatcaattgctcataaatgtatgggatttatttctggattttcagttctatttcattgatgtatatatctctcgttatgcaagtacttaatgcctgtctcaatgattgtagctttaagttttgaaatttgcaagtgtgagtcctacaacttctttttcaagattattttggctgttatgggttcttgcatttccatgggttttaggatcagcttgtcaatttctgcaaaaaaacaatgccagctagaattttgatgggcatcatttgggaagtgttgccatcttagagttaacaatattaactcttctaattcatgaatacaagatatctttacacttacaacacagggcatctttataggtcttctttgctttctttcaataatgttttgtggtttttagtgtacaagtcttggacttttaaatttattcctaagtattttattatttttgatgctattgtaatggaattgttctattaattccattttttggattgcttattgctagtggataggaatataactgatttttttgtactgatcttgtatcctgcatccttgccaaatgtctttattagtgctagtaaatttttgtggattacttagaattttctatataaatgatcatgtctctgcaaaaagatgtaagtgtggctagaacctctagtacagtgttgaatagaagtgctgacaggagacatccttgtcttttttctgatactaagggggagaacttcttgtctttcactattaagtatgatgttagctctgatttttttcatagataccctttatcagattgaggaaatttgcctgtattcttagtttgagtgtttttatcatgaaaggatgttcaattttgtcaagtgctttttctgtgaagattgaaatgattgtgtggtttgttctttgttctattaagtagtgtattacattgctttttctatatcaaaccaaccttgcattcttgggataagtctcaatttttttatggtttatgttgttttgttgaggatttttacgttgatgttcataaggtatgtttattggtctgtagtttcttgtgatgtgtttggttttagtatcaggatgacactggccttatagaatgagtagggaatttccctctctttctacattttggaagagtttttgaaggattggtattaattctttcagtgtttggtagaacacagcagtgaagacttctgggcctgagcttgtctttgtggaaagacttttgattactagttcaatctctatttgttatatattcatatttatggatagctatttataaatataaataataggccaggcacggtggcttaacgcttgtaatctcagcactttgggaagccaaggcaggtggatcacctgaggtcaggagtttgagactagcctggccaacatggcaaaactccatctctactaaaaatacaaaaattagccaggcacggtggtgcgtgcctgtaatcccagctactcgagaagctgaggcaggagaatcacttgaatccgggaggcagaggttgcagtaagctaagattgtgccattgctttctagcctgggtgacagatcaagactctttgtctcaaataataataattaaataaataaatataaacaatacatttgatatctatttagattgtccatttcttcctgagctcctgagctgtgtctatagtttgtgtgtgtttttttgtttgttttttgagacagagtcttgctctgtcgcccaggctggagtgcagtggcaggatcttggctcactacaagctccgcctcccgagttcacgccattctcctgcctcagcctcccgagtagctaggactgcaggcacccgccaccatgcctggctaatttttgtatttttagtagagatggggtttcaccgtgttagccaggatggtttcgatctcctgacctcgtgatccacctgcctcagcctcccaaagttctgggattacaggcatgagccaccacgcccagcctatagtttgtgtttttataggaatttgtccatttcatttaggttatctaattattacacacaattgttcatagtattccctaataattctttttatttttgtaagattggtagtgatgtccccactttcattcctggttttataaatttgagtcttctttttttttcttggtcaatatagctaaatacttatcaattttgttaatctttctaaagaaccaattttttatttcattgattttctccatttttctattctgtatttcattaattacactctaggctttattataatttccttccttctgcttgctgtggtgttattttgctcctgtttttctagtttcttaaggtggaagttttggttattcatttgagacattttacaactataattttactttaagcactgctttgtctatcttacaagtttttaatgttttgttttcattttcattcatctcaaagtattttctagtttccttttggatttttcccattggttaataggattgtgttgtttaattgccacatacttgtgaatttcccatgtgttctcttaatcatttaaatttcattctgttgtgattggaaacatactttgtatgatttcaagtatacatctattgagatttgttttacagcctaacatagggtctgtcttggagaatgttccatgtgtacttgagaaaagtgtgcattctgatgctgttgaatgttctacagatagctattaggtttagtaggtttgcagtgttgtacaagcttgtctttccttgttgatcttgtaattgttatatccattgttgaaagtggagtattgaagtcatctccaattattgttgaattgtctatttcgcccttcagttccatcagttttgcttcatgtattttggagctctgttgagtacatatatgtttttaattattatctcttttttgtgtattaaccttatatcattaaaaaatgtactattttgtctcttataacagtttttgtttaaaagtatattttgtttgaagttagtgtaaccatcccaactctttttgtttctgttttcatagtgtaactttccagacttttagtttaaacctctttgtgcctttcagtctaaaatgtgtctctttatagcatacagttagaatttaaaaccattctgccaatgtccaccttttaattggaatgttcagatcaattaaatttaatataattactattaatgtaattaacagtaattttggtttatgtttgccgttttgtcttcaatatatgtcatatcattttttattatttctccattatcactgtcttttgttaaaatattttgtattatatcattttaatttcgttcttgtttttgttactatatttctttgagttttttaagtaattatcctggggattacaattaacaccttaatttataatctagttcagattaataccaatttgctttcaatagtatacactgacttttctcctaaataggccttttcccctccccacccatcctttgtgctgttattgtcatataacatacatttttgtacattgtgtgcctgtctacagagatttataattattgttctattcaattgtcttttaaatcagataggacacaaaaagagttacaaacaaaaaatatactcatattttcctttagatttacttttgtaataacttttactggcactgtttatttctaaacatggattcaatgttttgtctagtatccttttgtttcagcctgaaggattccctttggtatttcttgatagcccatgtctgtcagtgatcatctctctcagtttttgcttatctggaaatgtcttaatttctccttcatttttgaaggatagttttgctggttatagaattcttgttgatagtctttttctttcagcactttggaatatgttatctcactgccttccagcctccatggtttggatgagaaatcagctgttacaatcttattgaatattgcacatatgtgatgagtcatttctctgtttctcagactggataatttcaattgacctgtcttcactctcactgattcttttctttcacatgctcaaatatgctgttgaacccctctagtgaaattttcatttcgtttatttttcatttcatttattgtacttctcaattccagaatttcaacttagttctcttatataatatctatcctgtttttttcacctttgctaaatgttgatgcatatcattttattgccctatattttattgttgtatcgtttaaaattttctattttgagacatccttatactttagttctttagtgtttgtttacggagtgtgagtttactgactcaggtatagtttattgactgatttttccttgcctgtgtatgggcaatacttttttgtttttttcatatcttgttatttttatagaaaactggacatttaaaataatatattttgacagctctgcagatcagatactgctgtctccccaaggctgtctttgttgttgttttgtaattttttttttttttggagttaattcttttaagtttgaattctttgttgtgtgtggcttctgaagtctctgctcatttagcttagtggtcagctaatgactggactgagatttcctcaaatacctggaatcagtaagtttcccagtctttgccaagggactctgtgtgtgtatagaagtgttcaggagaatatcttcaacactcagccaggcagttaacaactgtgccttaacctttaggtcctgctcgcatagagcaattagaggtgagagcttagggccttctcagtgtctttcctgagcatgaccctgggcatgagtatggccttccagattcccaggagatagctgaggttttcaaagcccctatggctatctcattccctagaccttcctgttaagctttttggttagccttattgtttgccctagctgttgtccagtttcttctgcagccctcaaattaatcagttacttctaattgtttttgacagatgtttccagggatgggggtggggtgcaagacttttgtactggggagctcagagtcaggtcaaataaatacagtcttcccagcagctaccaggctgctggtttcactctgattgcatattgattggagggagggggagcagatgggagcaagttaaaatgcttactgttcttatacggattcagttgttttacttgaataaatgttccccagattgctgcatgcctttagttaatttccagaattctgtcaaagtagattctaaatgatttttgcacccccctcccccgctctttctttttttttttttttttggtgctttgatagaggagagacttttgcaggttctttctcttctatttttgctgatgtcactcctgctgttctttttgagaagacaacgtttattacaattcctcttccttcttatgtgaccagttttaggtgtctacttttgtttaactagagtttttaacttttttttttttcttttttttaagctgtgctctgaagtttcagtgatgtgacttggtgtgggccttttcttacttactgggctgtggtctttgaacttcccattattttcttgatattttccttttcactgtgtgtttagtctctttctgatagtcatattaagaggatgttgggcttcatgacatcactccctgttttttatcgcttcaactttttattctattctgtgagatttccttgacttcagattcccagcccttctattgaacttttatttccattatcttacaaatttccaagaatccttatttttaaaattaatccctttttagaattctgctctagttttattttattgctctaaggatattatttttttttaattaatttgcctctgtaccctgcattgtccgtttcctgagtttccttttgtccgtttctctctcgtttgttcattttaaagagataggcacaaaaaagtcaataaatggcgatgccatctgtttgctgtaaaaacaatatgaatgtatcacttttttttttttttttttagctcagatgctaatgtgtctattttttggttagttgtgtgtcagctactttcccgttaaggtttacagtcaagaaaagacccattggtcttctggtttggggcttaagttgtgctgcagcatgttctttcttgtacctttttctgcttctattagaagtgctttatttagcattttggtctgcagctgctttctattgctattatccgtcattgcatagatcaaggtttactgagttcttagactctcagaagagattacttctgtgctggtggatgggcttaacctcaggaatctgtctttatgatgtaaagaaaaattcataatgacccagcaatcctactcctatgtctatacctcaaaggattgagaatatttaggcaaaaccttacacacaaatactcatagtggcactattcacaatagtgtacaggtagaaacaacccaaatatctatcagctaatgaatggataaacaaaatgtggtatgtccatacagtggaatattatttggccacaaaaggaatgaaatactgataaatgctacaaactggttgttgtaacattgaagacattatgctaagtgaaagaagccaatcacaaaaggccacatattatatgatattatttacatgaaatgtccagaataggcaaatatatagggacagaaagtagattagtggttgcctagggatatgaccactaaaggagctagggtttcttttggaggtgatgaaaaattctaaaattgacagtggtaatggttgcacatatcgatgaatatattaaaaaccattcaattatatactttaagtgcattaattatatggtatataaattatttttatcttttttgagatggagtctccctctgttgcccaggctggagtgcggtggcatgatctcagcttgctgcaagctccgcctcccaggttcaagcgattctcctgcctcagtccctagtagctgggactacaggcgcctgctaccacacctggctaattcttgtatttttagtagagatggggtttcaccttgttggccaggctggtctcgaactgctgacctcaagtgatccgtctgcctccgcctcccaaagtgctgggattacaggcatgagccactgcgtccagcctgctatgtaaattatatctgaataaagctgtttaaaataaaataggcttgtaaaggtctcaaaaaagagtgttctagaagcctgctatgttaattatatttgaataaagctgtttaaaataaaatagaaaggcttgtaaaggtctcaaaaagactgttctagaagtcctgtctgtattaggctctgccttcacctgttgtttctgctcctcacatccaaggtcacatgaaggcatctcctcttgcagcctctctttacatgttgaattcttgctttttcttcagtcgagctttgatccccattacttaccctagacttttagaatcaaggcttggttttgtttcttccccattttttttagcttgttcaaattattgacattttttaccttttatcctcttgctaaaaatcctatacaaaagttgttgtttctgtcttacagccctagctgctctttcaattctgtgtttagtatataatctataaataacctatgtgttatagccacatgtcttttttttgtgtgtgtgtgtttttttatagatggagtgttattctgttacccaggctggaatgcagtggcagaatctcagctcaccatgacctctctttcccgggttcaagcaattctcctgtctcagcctcccgagtagtggggattacaggcacgcaccaccatacctgactaatttttgtatttttagtagagacagagtttcaccatgttggccaggctggtcttggaactcctgacctcaagtgatctgaccacctcagactcccaaagtgctgggattacaggtatgagccacagcgcctggcctacatgtcatttaaattaaaacttaaatgtcttggttcatttactgttgatgattttacagacttaacagtgaaaacgctgttggctaagaaactttaggaactctgggtgaatacagggaatgtcctggctttagagctgtcatctagtcagtagtggttcatttcatctgggcctagagttcacatgaattaacctagggagcctagtgttactgggaataggaagttagggatggcagctcttggttagatgacattgacaagtggtgcttttgtgcactgaagagaaaactttaaaaataattggcaaacttctcttccttggccttcctgttgacattacttatctcattatcttaataaggtttcgtgttagttttcacatctctctttcaatacatttgtcatcaaaggtaccattcttcttgccttgaatatatacagactaaatatctgtctctccattattccctccctcccttttcctgaagaacttggatcctccaataatctattactgctcttttggaaactcttttgcctactttaaaatccactggctccagtttattgtattgttggctgcaaagcaaagtactactttgactgtagtttctaactctattcctgtggcttagtttgccctttacctctagcaacatgatgcttctcacatcctctctgtcctgtctgcttatcccctcttattttcccatgcagcctgaggctggaaatgacttcttattttgtacttgctaggttgttgttacagtctccgtggccaaaaggttaaggaaaaccaggaaatatttactcaagtctacctttttatcttagtatctattctaatatgttctttactcccttcatgtatttatagaatacacatacttcctattcatgttaactagcaaatgtgcagcagagcattgaattaaaggatgagtaattaacaaattgatggatttctcaaaatacccagagctctttattcatcttactaaaataaattactttacagggccaagagcaatttcaagcataatgctgcataaaagttttctggtttttttttttttttttttttttttttttttactgagcagagtctcgctctgtcacccaggctagagtgcagtggtacaaccttggctcactgcaacctcctcctggattcaagagattcttgtgcctcagcctcccgagtagctgagattacaggcgtgcaccatgacgcctgactaatttttgtatttttagtagagacagggttttgccatgttggccaggctggtctcgaactgctgacctcaagtgattcgccggccttgcctcccaaagtgctgggtttataggtgtaagccaccacacccagccacaagttcctaataaagtccttgtatactttattattgatagtgtaattacttaattttagatgtattcgaggcacatctttcaatggtatttcaaggcagatttttttagttataaaaatcaaaatatctacataattaccattataaaggtaatatatatatactgtaacaatttttaaatatataaaaactcaactataagccattcagcctattgacttttaatacatattattcagtactattttaatctatatatacataaattaaaagcagatttgtttgtgtatgacaactatattgttataggcagtaaaatcaattcagattctgtgacaaaggaaaatggctgtagtagattagaatataagctggatagtagctaggaaaataagtccatgttaactttgaaggaaaagaaaaattgtatgtaaataaattactaaatttgatttgccatactgtttgagttgaaaaatgatatgaaaatgtaaagacctacatgccttacgaacatatcagaaagttttctggggttctaggctgtaaaattgctggtagatggaaatacaaagtagtggttctgtctttttctccctgaaaatgaaaattatactgtttttttcctgttaaagtaattgtgaagaaaattcagaaactgaaaaccccaaacaagaagagaaaattactcattctacagacaataaaattagatatcatttcagacctttttataatagaatttttgcagagtattataaatgcttctttgtaactgttttttttttgtttgttggttggttttttttgctgcttaactatctcttatgccagtatatggagttctatataatatctaattaatggttaacaatattctattttagaatgtactttcttttacttaactaatcccctatttaggttgtttacttttaggtattctgcatagagctgtgatggatgttctcatatatactttgcatgcttttctgcttattttctcaggataaatttctggaagtgacattgttgtgtgaaaggtacatgcttttttttttttttttttttttaaatagaggcagggttttattctgtcacccaggttggagtacagtggtgagatcatagctcactacagcctcgaactcctgggctgaagtgatcctcctgcctcagcctcccaagtagttggggattacaggcatgcactaccacatctgggtaattttaaagttttttttttttttttttttgtacaaacggagtctcactatactgcccaggctggtctggaactgctgggcccaagtgatccccctgttatggcctcccaaagtgttgggattatatgtgtgagccaccagacccacccaatatatgcttttctttttttgtttgtttttgttttcttaatttagagacagtggctccctctgtcactcaggctggagtacagtggtgccatcatacctcactatagcctccacctcctgggctcaagtgatactccttcctcagcctcccaagtagctgggatcacagttgtatgccaccatgcccagctaattttagaaaattttttgtagcgatggggtcttactctgttgtgcaggctgatctcaaactcctggcttcaagtgattctcttgtctcagtcacccaaagtgttgagatcacaagcgtgaatcaccatgcccagcctagtacatgcatttttaatttttttttttttttttttttttttttgagaaggagtcttgctctgtcacccacgctggagtgcagtggtacgatcttggctcactgtgacctccatctcctgggttcaagcaattgttctgcctcagcctcccaagtagctgggactacaggcatgtgccaccacacctggctaattgttatatttttagtagagatggggtttcgctgtgtgggccaaactggtcttgaactcctgacctcaagtgattcacccatctctgccttccaaagtgctgggattacaggtgtgcatgtttaatttgcttctagtcaccatgctgcccaccagaaaggagtaacagatttatagttacatacaagatagggttaacttgtgcccagttctgtgctataatgcactgttaatgagactcccggaaatatacaaagccacagcagtattatgatggagtttatgtattagagtttcacatattagaggagttgggttgggttcaacagcgagggaaatgcttatattggcaacttggattgtgttgtattcattttcaaaagcagcactcaggctgggtgcggtggctcatgcctataatcccagcactttgggaggccaagacaggcagatcatgaggtcaggagaacgagaccattctggctaacatggtgaaaccctgcctctactaaaaaaaattagccgggcatggtggcaggcgcctgtagtcccagttactcgggaggctgaggcaggagaatggcatgaacccgggaagcagaggttgcagtgagctgaggtcgcaccactgcactccagcctgggcgacaaagcgagactctgtctcaaaaaaaaaaaaaaaaagcgctctcccaccagcagttaaactgtgatgctatgagtatgtgttgatattttgctgttttgaggatttgggcatagagcacgatccttttcttaccttagatgagtgaccgaggaggtggcgttcctttgaggaaaattgacagacttttcaactacatgtattcaactgcaccaagacctcgtgttgagacctcccgcgcagtgcctctggtatgttatcaagaaataatgaagtgtgtttctgtgaattgccttccacatgctgtagctgccaaataagtaagttaagccgtcatgtagggtactccacaaggaagaaagaagctcttagaaatgcacactttcccctaaatttaaacagccttcagaatacttttttttttttccaactgaaatgggcacgagacagagatttggagttcttgttacaaagtttgatcgtgatatagcagtagttttcctgtgtaaaaccacattttgaaatatggttaaccacattatttctaatgtggggaataaattactggttttagtagtgtttggtcaacactgaattactttttagtgttgacttttttctcaagtacttgtcattagaatgatctcatatcctagactgaaaaataagactaaaattctaatctgttcaatcaccaacctgaaggcttaaattataattgctttgatggtgttttgttaatcttagttccacctattttcaggtttaataggatcaacttttgaattgactccatccttatctttatgttctaactcccccacaaaaagtatgttgccaaaattttgtctgtaattctagaagaactctattcttctaggcttggaaacttctctgacatttccagtagagttatgctgtaacatgatgggggtatagtacaagatagatctattttagaccccttcctaggaagttactaggactttattctgatagttttgtgtccggaattggtgggtttttggtcttgctgacttcaagaatgaagctgcggaccctcgcagtgttacagttcttaaagatggtgtatccagagttacttcagatgttcagatgtgtctggagtttcttcctcccggtgagttcctggttttgctggcttcaggagtgaagctgcagaccttcacggagagtgttacagctcataaaggcagggcgtctggagttgtttgttcctctcagtgggttcgtggtcttgctggcttcaggagtgaagctgcagacctttgtggtgagtgttgcagctcataaaggtggcacgtccagagttgtttgttcttctgggtgggttcgtggtctcggtggcttcaggagtgaagctgcagaccttcgcggtgagtgttacagctcataaaggtagtgtggacccaaagagtgagcagcagcaagatttattgtgaagagcaaaagaacaaagcttctacagcctggaagggtaccagagtggcttgccgctgctggctgtgggggcctgcttttattcacttatctggccccacccacatcctgctgattggtctattttatagagagctgattggtccattttacagagagctgattggtgtgtttttacagagtgctgattggtgtgtttacaaacctttagctagctagacacagagtgctgattggtgcatttacaatcctttagctagatacaaaagttctccaagtccccacccgattagctagacgaagagcgccaattggtgcatttacaatcctttagctagacacagagtgctgattggtatgtttacgatcctttagctagacagaaaagttctccaagtccccacccgacccagaagcccagtccagctggtttcacctctcagttttgcctgatgcatagcacaaatgctatggctgcagctgtactatagttgaaatgcttgctctagtaatgtccttctccaattcagatacatgccctccaggagttggcatccatatgtcaaggggcagacagacaatgtcaaatgataaacatgagcatctttttacaagtctagttttatcctaaaaagtagagggatagaagggagctgctgtttttgtagtaaacgaatattgtagaatttttatggagagcggcatagtgagctagtccagactctggatctaaactctttggttctgtttctgatactgctgcatcttagatgtgcagccttgggaaaattattgacctctggatgccacagattccccacttagaaaaatggagttattgtgagaattaagtgagttgatacatgtaaaaatgctctttatggtgcctggctcatggtaaatgccatgtaagtgtgtgttattttaggatgtaaaatgtatgtgaatttttaagaaaataggaggcttgacctggaacaggctcctccatacatctacatgcccttaacaaggctaagactgttactaatttcttgcagagcctcctttctgctgacatcgctttgtagatggtcccagtcagcaggcagtagggtagctggagaaaggccagctgatgcccacaggagtggctttcttgtctacctggttacggagggcttcctccctgtggataccttcttgtgggtctttgcatggataggctatcttcacactgtaagtccggagaggaacatccacacatctctgttccagacctccttctcatccttcactcagttttgttctttccaagtccttaacaagccagccacttgttttgccactgcccatgctggaagggtttactttcactgctgtctttcaggcctgccctccaaccttgagagggattgtagtaggaaaacggcagcttactttcagatggtgatagcacatggggtagatccaccagtggactaggcccatgttgtttttcttccctgttaactggttataggggaagccctatgagtcagcccataagtatggtcaagagagagcacgtggtaaagtaggtcaggtatcatgggagcctgaaccacctgctcatacagttttcttcgggccacttctaagaccagttaatgtatcgctcagagtcacaacaggaaagaggtagctcactcaaattatgaaagaaggcctttttacaaagaaactaattacataggtgtaggtaaagatagcacaggaacccagggctagcagcagcaaagctatcaccaccttggatcatgagggatgaggagaaggcaaagttagcagaacccagaggaagggaaagctgcagagtagctgcttactctccaggggcccggcctgcccaaggcaacctcagggaaggaaccaggggagtaaatacccaccttgacttcctctgaactcctgctgggttttccaagacatgctgtaagcagagggcatgggaatccagtgacaatccaggttagcctcccagggcagggaggtgtgaaatggaatagttgatttgtacgggcaaacagagactctgggtagaaaagtcaagttatagttggtggagttaggtaaagctggagcctgggtttgtgaatagcactctgattcttgagtccatacaagctcatagttagcatgctatatggaatgtcatcaaacatatgacttggtaataaaaaccattttcccatttatccagatgttttgttttgtattaaggaattggtaggatttatccagataaagaggctattctggatactgggaccaaaatgaacagacacggaatgatatgtttaaggaacttaagagcaagaggtgtagttgtgctggactggaaagtgggaggcagagacctgatcttaccaggtctagaaagctctttttagaagcttaggttttgatttctaagacagtggggtaggggtggtgggagtgctggtatgttttgaagatttttaagtggaaaagtgacccgtcagtgagaattaagaaagtagatctatattagagatatctccaggctcagaatgtggctggaaatttatgatattaagtcatgagatatatctattaggctgcaacaagccattttctactcttgctcctaaaagagataacacattttatatgatattgccaagagcagtattgagataccatatccggaattggtttcttctggtaggttcttggtcttgctgactttgagaatgaagctgcggaccctcatggtgagtgttacagtttttaaagatggtgtgtctggagtttgttccttcagatgtttagatgtgtccagagtttctttcttcggtgggtttgtggtcttgcttgacctcaggagtgaagccacagaccttcgcagtgagtgttacagctcttaaaggtggcatgtctggagttgtttgttcctcctggtgggttcatggtctcgctgacttcaggagtgaagctgcagaccttcgtggtgagtgttacggctcataaagatagtgcagacccaaagagtgagcagcagtaagatttattgtgaagagtgaaagaacaaagtttccgcagtgtggaaggggacccgagcgggttgccactgctggctggggtggccagcttttattcccttatttggccccacccatgtcctgctgattggtccattttacagagtgctgattggtgtgtttacaaacctttagctagacacagagtgctgattggtgcatttacaatcctttagctagacagaaaagttctccaagtccccacccgacccagaagcccaactggcttcacctctccatcccccctctaaacagtataccccaactgttgttgggaattgggcgatgaccgctgtagctacttcttgctggataggggcaaagaaggggccctgcagttgtagtgtcctccagaggggaactctttaggccagtgaaagggccagcgggtcagtccaggggtccttgatagaagttgttagttgagttcatttgggattccatttgtaagaccatctatagcttgatggccttgattctagaggaaacaaatttgacaaggaggttaaaaatacagggtccgaaggtgagtaatagcaagatggctgtcacaggacctagaaaggggagaagccatgttgcccaactccagaggttggtataagagtttgaaaggtgttgtctgatttcggaagacttttcctgtaaacgccgggcggcatctcatactatccctgactggttagtgtaaaaacaacattcttctcctaagaaggtgcagagtcctccattctcagcagtgaggaggtttaggccttggcggttttggagagtcactgctgccaaagagtctatttgggattgtagagtaaggatagatttcgttatttcttgcaaactgtctaagaaatcctttgagagtgtttggtagtaggataatgaagtagataaactggctgttccggttcctgtagcagtggccatttctaactctgtaagtaggggtattagttgtatggccctgcgctgatggacttgagctttgaggggcactgatagggtctgatttccataagattagaagttaagataataaatgttacactgttaacttttagcaaactttacttttgttgaaaaccttgtaagtttggaatttcaattattccttgctattaataagacctcgttcagtccatattaacttaaaattggtatagatggctccttcctgattctgtaagtactttaaggtttggctgagtgcaaacagctcgcatatttgagcagaccaattattaggcaattttcctaactctgcttctacaatagtttccttattacttactgagtacccattgtgtctttttcccttaatcgcctgggaggaaacatctattgtcctgtcctgaagggagttcctcctgtgtctggtcggaccttcagatttagatcccctgttaggaaacctgctgggttaaggatttttgataggaaagctacgggttgtcagtggtctcagtgcttccgggctatgcccttgtttacactgacaacaaggtggtattggagtgttatagggttacagagaagaccttcaattatcagttataggttttaaatttaccctggcttttgaaggaatagggtacactgttttttctttactacttctatctctctttctctttgacttctttgcctctctctttctgactcctctttgtctcttcctctctctgactttttgtgtctctctttctctctctctctgactccctctttgtccctgtctcttcctctctctgtctctgactttgtctctttctttctttctctctgactccctctttgtctctctcttcctctgtctctctctctgactttctgtctctttctctctttcctttctgctggtctttccctgcctctgccagctgcttatgctgctcttctcccctctcctggagaagtccgcagaccaagaacccactggaaggaaccaattccagacacaatacgaccgagcaggccagcaaggaaaagcaatatgctttttcgagaccaaccacaagtcattttatagaaagaataaagagttttaaatgaccagagggaagtcagctgatacagtactcaagtaaacctcagcttaatcattgtcaatgcttaaatattaattatattaaatataatgcatctctcagatgcgggctctgatagccccgtggtactcaatggcatctatcttaattagaaaagtatttcagtgtgtgtctttctgaatagaattttgtttttctcatcaaacaggctggttttggttatggattgcccatatcacgtctttacgcacaatacttccaaggagacctgaagctgtattccctagagggttacgggacagatgcagttatctacattaaggtaatagctgtagtcttcttgatttaatatttcttttgatgataagaacagatgtccatacttaactgtaatgaaatttaactctaccacatgctgtttaaatagaaaaaaactatggttttttgctggggatctcacccattttgatagatgatcccctaaaactatggggaaagagatttgtatcctggagtgattaggactctgtctattaataggaaaaaaattgggttaaagtagagaatcataagttatatatcatacaagtttaattttaacataaaacacatgaatggacattgataacgccaaacttttgatgtactgccaaggctttttttttgtatatgggtctgcagattggagtgtcacattgtcttttttgcaaaagctgtactgacagtgcatcattttagtttctttaaaccaacaagtgcatactctttttggacttttatgcagtcctttacagatacctcctgactgatttgacagcaagttttatgtgactttccttcatgagtctttccaaaacattcatcttagttttcaaggaaacattcccctttttattctttgcttatgtaataaattttgtaattatcatgacagaattgtacaaacagatttgggaacaagcacaagtgactcttggtaagcatatagcttacctaatggacacagaagcacttagtctgcttgcctggagtgttcaatgcattaaggagggttccacacattttacatggtggaaaaacactaggttccatcattccccttcttcggctaactggtggctgtttatgcctgatttagtgactctagtttcttgttctggccactagatggcatctattttataggaaatgttgaagaatttatattggaaaaaatatctgaaaagactaaattctttctagatggtattttttgtttttttaaccatgtcaattgcgagggaaaagggcaacatcaatgcaatgtttttcttttttttttttttttgagacggagtcttgctctgtgtcacgtaagctggagtgcaatggcatgatctcggctcactgcaacctccgcctcccgggttcaagctgttctcctgcctcagccttccgaatagctgggattacaggcgcctgactaattttgtatttttagtagagatggggtttgaccacgctggctaggctgatctcgaactcctgacctcaggtgatccgcttgccttggcctcccaaagtgctgggattacaggcatgagccaccacacctggcctagtgcaatgtttttatgacaaaatgtaacattttgatctagcccaggagtgtccaatcttatggcttccctgggccacagtggaagaacagctgtcttgtgccacacataaaatacactaatgatagctgatgagcttaaaaaagattgcacaaaaaaaaatctcataatgttttaagaaagtttacaaatgtgttgagcttcattcaaagccatcctgggccgcatgcagcctgtgggctgtggattggacaagcttgatctagcctgtagatcaagaaattctggaatatttagagaaatatggaggtgaaaggttttttgttctaccttagggaaaatagaagataagaagtcttagagaatcattaaaattgtcaacatcaaagactttagcattatcagaatgagattttcttgttcagggtgttctgcatcttaggaaatgcctttggcctgggatggaaatactactgaaaaatcctaacttgaagaagataactagaaatgtagtttatctcaggttccagtgacttataggaagctgaaatacaatggagaattactggtaataatatatggaaaactgaaatcatgcatgatgcagaaatcttgtgcacagtgactgaaattggaggccggagaagacacagattcaaacccagggccaataaatgttcacgaaaaagctaagatgccttagacatagatttctatttattaataatgttataatgagtttttaaatttttatgtatttatagagtcaatatcttgctttgttgccaggccggagtgcagtggtacaatcataattcactacagccttgaacccctgggcttcaagtgatcctcctctctcagtctcccaagtagttaggactacacccatgtgccaccatgtccagctgatatttttattttttgtagagacaggatcttgctatgttgcccaggctggtctccaactcctgagctcaagcaatcttcctgtgtaagcctcccaaagcactgggattataggcataagccaccgtgcctggcttgtgatgagttttttttaaagcacagtgactatgctgaaaaaaacactatttcttctagtaaataattaaaatagagttcattaaatttatgtgcatctattaagatacatatatcgatttgtatgcttttacatttaaccaacttcttcagttagccaactctgatctgggtcatgttttgtgtaaaatttcagtccagcagcttccaggatggctggggaattactgtaagcaacaaactcagtcaacctgcacatcagtcagtgccatagatttcataaataacacgtttcaaatatacataccatttaaaagtatatttaggtggtataaggattaataagatactaatagaatattatttaatttgtcgtaacctttttgccattgtctattttctcaaataatgaattctaaaaaatgccagacttaataggtcttaggtttttctttttcaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaa

SEQ ID NO: 14 - DNA, 90666 bp, homo sapiens
ctttcccctccctcgcccgccccgccgcccgcaggcgccccgagtcgcggggctgccgcttggacgtcgtcctgtctgggtgtcgcgggccggccccgcggggagcgcccccggcgcgatgcccttcaggaaaggtaggagtcccggtgacgcggcccacgcccccagcgcgcgcggggacctgagcggccgcctgtgggtacccgagccttgggtcctcgccaggcgcggaagcactgtgcacccgggctgcggcggtgccgcccggggccaagcgagacgcgctccgccttgtcccctccgccctgcgctgcgccccggacccgcgtgtccctccagatccgcactgtctcctccggtcctgcgtgtcccctccggccccacgcgtccccctccggcctcgcgtctcctttccggcctcgcgtctcctttccggccccgcgtctcctctgcagccccgcattgtgcctccagacccgcgctacctcctccagacccgcgcgtcccctctggcgactccggccgccaccacgtgcccgagccgggggcggcacttgcagcgaattcccgcttcccgctgcgctccagccccgggccgcagatataccagggctccggacccggagagacccggagggcggcggggcccggggtcctgagggcgggattggtgggctcgggggcacggagaggggcagcgcggcgcgggaggtgggcagctctggcctgagtcccacctttgcccctcccgccctctgacccccgggcagtcatttcagcccccagccccagttgcctcctgggcaaaaccgacagatggctagggacggccgcgtgaggatgggagccgtccccagaaaagcaaactcaggcccgctgatgagcgcggcccggcccctcctgcaggggctgccctccgccttttccgccctgcgtgccagaaaggcccggctacctggtgttcctacccgcaccggggggtcccagcgcaccggaccccggtttacaggccgggtggttggaggcccagcactgcccagagccctgggcccctctcagctcaaagacccgggagagaagtgggagctgcagaagtgtggggaggggggcctcgatttgactttcaaatcagagttgtgtgactcctgcgccgtctgtttgggttgggaggggttgagttctggtgatgattgtcactcaacacccgagactcccccactgcgacctgggcacactaaggacgttgaggactgggggtgtgtgtggggggagcctggcctcccctggcactgggcctgtgctgtgccgtctctcccttcccgcacccacccatctgcctctcttctctcataactcagaggcacggccagcgtgatgctacggttgcctggaggctgtaccggacttgtttttcaaacagagggtgcctaggtatcagcgtgggctcctggcggtgaagggggtggctgctgactctcctgtcccgttggggtagagagatgggggagggtggccagaaggaaggtgacagccagcaagcaggggctctgccactcctctgtcagctggacacgtttagtcccaaggccactgtcttcggtgtctccattaatccaggtatgattcggccaccttgactctgtgggttctctggaggctctcagagtgtccctccccccctactcattaactgcaggggacaatcatttatctctgacttcatcgcttctgcccacttttgtcgatgtaggctctggttgggaaactcctaaaagggacagacttctgtttacttgtgcgctcagtagagagccttatgcggcaaagtattaaatagccaagctgctaatgtattgtttgcatatgaagattttgctttatgacagcgtattttagtgcattattagatcacacaggacaaaacatttgcaaactgccaaccaaggtaagctttggttttttggttattatcattgtttaatctgaagagaccttgctgcatgaagaggaaaatgttatccttgcatttggcagatgctacttcctggaggtcccagagtgtaagaaactgttgcttggcataagtgctgtctgcgtttcccggtcaccctggtgtgagccagggcacaggctcttggaggctttatcgaggcagagcttccccagttgcaggtgggacctctcacttagaagtaagcacagcaagtgggaactgcagggagccaggccgcggctgggtttggtgctgagccgtggtctgaagctgcctggaggggacaaggtcctcctgtgagggacagcacggcacgtcaaccctgcactgacggaggtgcaggagacgccagtgcagctactcttctgtattttttgacctttgagcgatctgaatgtgttaactattcagaaaagtaatttaaaaattgggaaatgaaaagactttgccgccctgctcccaaaaccaagagaagccatccggagaaggcgtccatcctctgcgggctggaagctgagcagggacaactgtggattccctccccaggctgtgcttctgcctcttgacaagcttcagactttgggatcagctccgtcaggggcccagcgggtaccaggcaagtcgaggagtttaatgatggggagatttgggtaggagataggaaaaccgtaagggatagtgcagagccctgggcattagcaccttgaggtttaaaatgtcaagtggcagagccaaaactagggacagcctgacagggactgtggcctctgttggagggggcgggcagtgtgtagcctgcagagagggagctgggagaatcctcaacctagacctcactccttcctccctctgatctcatggctttggcagccagagggccggggagcctgacggggtggtccatacaggggacctgacggggtggtccatacaggggatcctgatggggtggtccatacaggggagcctgacggggtggtccatacaggggagtctgctgggacacagagctgggtggatttcccttttggaggagagagggtcttcagggtacaacagagaagcaaccaaagatcttaggtgctggtcctgtccctcacttatgggaggaactagtggacagctactgaatgtagttatgggaaagatgagtggttgtgtaccacggcattcattcattctctagattgggcacttgctatgcaccagcacacgctaggtaccagctgaacagcaagacatggtgtctcctccctggagcccacctcctgtgctctccagcaagtgccagggaggggagtcagaagtccaaatgtagagcagttctcagtaggaagccccacctgaggaggctgaactccgcatggagagggtgtggcactggttgacctcctggactgtcacacaggctgtggttaggttggtgccatggtgctggctagaatggagccagagggacttagacctcatattgcacctgtccaacatggaccgcagtggtatggcacgtggcaggcaggaaccatatcaagtgggtggtggctgcatctgggccatgtcccctatgctcagcgtgaggctggagcagcagctgacagtggcagtcctggcccaggtgggggaaggatggtgcaagcattgccttcagggctcacagctcttcctgtgggtctccagggtgacggtggttagagtgggaggaaggtctgagtctttggccaatctgtctagaagaaggagaagttagtatcttgacgtgaaacataaaagaaattcatgagacgaaaaggaggcaggaagcacttcagctggacacggagaggaaagtcatgcatatcatgactaactttgggaaccacaatggagggacgctggggcagttcttcctctgcaagaacttctctccttagaaatcgaatagatgggccagtgtggtggctcatgcctgtaatcccagcactttgggaggccgaggtgggaggatcacttaaggccaggaatttgagaccaggctagacaacatagcgagaccctctctctaccaaaaaaattaaaaatcagctgggggtggtggcgtgaacttgtagtcccagctactctggagtctgagatgggaggattgcttgagcccaggagttcaaggctgcagtgagctacgatcacaccactgcactccagcctgagtgacagagcaagaccctgtctctctaaagagaaataaataagacagatggtgtagacggtgactcatctcaggtgatggaggcgtggctctaagagactgtggtcttgaataaatcgttgaggtccttttcaagtctagaatcctataacaatgtcttcagacagcagtgttccaaggatttttgtacgttccaccttcagagggacaagggaatagcaggtgaaagttctaataataaataacaataaggccgggtgcggtggctcatgcctataatcccagcacttgggaggccaaggcgggtggatcacctgaggtcaggagttcgagaccaggctggccaacatggtgaaaccctgtctctactaaaaatccaaaaattagccaggggtgggggtgggcgcctgtaattccagctacctggggagctgaggcaggagaatcacttgaacccaggaggcagaggttgcagtgagccgagatcgtgccactgcactccagcctgggcgacagagtgagactccctctcaaaaaaaaaaaaaaaagatacaaaatgcactgtgtgggatgtgagggcaatctggctgtgacatctgtcaccccagtaatcgtcagggttgatttggctgatctggctggctaggtgggtgtccccttcctccctcaccactccatgtgcgtccctcccaaagctgtgtgctcggtccaagaggatgaccatccccaatagaggaggactcatcttcagtcaagggtacacgagtagctgcactcccctgctagaacctccaaacaagctctcaaaatgcactgtgtgaccttactataatatcctccagttccatcccaaggatttcactcttttttatggctgagtagtattccatgttgtatatgtacattttctgtatccattcatctgttgttggacacctaggttgattccatgtcttggccgttgtgaatagcgctgcaataaacttggggtttggatgtctcttcacgccttttaagttcatgccttttctgtcaccttttccattgattctatgcacatagcacctcttgcaggcatatcttgtcccataaccagaccggaacactcatttgttctcagaatgctttctgcatggtaacttggagagctatttgagttacggtctatacctcatgcttatattggacctggtggtagcaagtgtttcataaattcttctacttggttaatctgtcattttcttttggaatgagtagttgcagagccacattaagatccttataggccaggcacggtggctcatgcctgtaacccagcacgttggacggctgagtaaggtcagaggattacttcagaccaggcgttcgagaccagcctgaccaacatggtgaaaccctgtctctactaaaaatacaaaaattaactgggcgtggtggtgggcgcctgtaatcccagctactcaggagactgaggcacgagaatcacttgaacctaggaggcggaggttgtggtgagctgaaatcgtggccactgcactccagccggggcgacagagcgagactgtctcaaaaataacaataataataaatccttataaaccctaaatgctgaaagatgatggcatttccccatgcgtaatttaaaataaagacaatacccaggctgtgcgtggtggctcacgcctgtaatcccagctcttcgggaggccgaggcgagtggatcacttgacgtcaggagtttgagaccagcctgaccaacatggtgaaaccccgtctctactaaaagtatgaacaattagccaggtatggtggcgggcacctgtaatttcagctattccggaggctgaggcaggagaaccgcttgaacctgggggggcggagattgcagtgagccaagatcctgccactgcaccctggcctgggcgacagagccaaactcagtctcagaacaacaacaacaaaaagcaaaaattgcctatcattcatgacggcaggggaagagttccaagatttccagctgggcggttgagacggtggaccaggacagcagggagacggacacagggagggagccccagtctgtggaacaccatcccacttaccgtagctccccactggcagtgtgtatgagtcttggtggtatcttgtgtgcgggtctgagctagggggcgtggccccaggagcatccaaggttctggttggggcagccacaaggtgtctgaagagcagcggggtttggtcgtcctggcacttccgcaagcagcctttccagctgtagctccggaaggtgctctgacatgacagttcaaaaacacacttccccctggcctgggcttcaacactcacttgtcagaaagtgaggtcctgtatgccccagtcctcggccagagaagcaagaagcagatttcccagaggctgtggccccttgcattggtgaggacactggggtgctacctctgtttgaggggtgactgacaactgtgctttcttagggtggagttggtctgctgtcgtgactgtctgcttgagatactgacccctggcgatcagattctggaagtcctctcctgaggctgctgaagtcgtcccagaggcttgtccagccacagcagtggagaaagatccaatcaggcaggcaggggcaaacgggaagtcgggagggtaccctccccgctccctgagaagtgtggactttcaaaaggaagtgagaaagaggaaggtcttgcctaggcatggggtagacctgtttgatgcaggcggacttcagggaaagctggtcctcagtgccacagtgctgtggctgtcgggcggcaggcactggctcacagccgtggtggggacgccttgtttctcggaaggacagaaccgccctcctgcagctcctgttcctggcttcacattagaattaactggggagctaaaaaaaaaaaaaacctgatgccccagaaattctgatttgatagtttctgccttgatgcctagacaaaaaatgtcctgaaacaatacttcacctcagacaatactgtacatgctgatgttttctagtctgttccatttcattaagaaagattctggtcttattccagtaaattgatttcaaggccactaatgggtggtgacccacacttttgagatgcctgttccgggcatcacctcccactgcagagcctggggagccggacagctcccttcccaggctctgcagtgggaactgatgcctggaacagttcctgcagccggtctccagtgtgattcaggtcctgcggcaagttctaggtggtccaagtgaggcagaagccttgctggaggctttacccgtccacactgctgtggagcctctgagcctccatggaggctccccaagccaggcagcaggggaggaagcgtctggtaggagggtggaaggcatcacgataactagccacctgcaagggctaaatctctctgggacgtttgcacgaggaacattccgaacccatgaatagaggagggctgcggatctggtagctgaggaaattcagtagaaaagcgagaaatgtatgccaggtgcagtggcacacacctgcagccccagctacttgggaggctgaggtgggaggattgcttgagcccaggagagtgagaccagcctgggcaacatagtgagatcctgtccctacaaataaaaaattaaaaaattagctaggtgtggaggcatgtgcctgtagtgccagctacttgggaggctgaggtgggaggattgcctgagcctgggaagttgaggctgcagtgagccttgatcgtaccgctgcactccagcccgggcaacagaaagagaccttgtctttaaaaaaaggaagaagaggctgggcacggtggctcacgcctgtaatcccagcactttgggaggctgaggtgggcagatcacctgagctcagaagttcgagaccagcttgatcaacatggtgaaaccccatctctactaaaaatacaaaaaaattagctgtgcatggtggtgggtgtctgtaatcccagctactcgggaggctaaggcaggagaattgcttgaactggaaggcattgagccaagatcatgccactgcactccagcctgggagacacagcgagactctgtctcagaaaaaagaaagaaagaaagaaagaaagaaataagaacagagaaaagcaagaaatgtaattgaaaggccgatgggctgccctgtcctgcgggtgcctaccctcatttatgatgcaactgaagtcacttccataagctcttcggtcctttcagcagtgcccagtaggccaggggcggatgtaagtgcagaggctgcggcagtgaacaaaacagacaaacctcggccatggagcttacatgtgaatggggtaagcctgtgtggcttggtccttggtagatgctttgagtggctggtaggaggtcatggtgacctccctgggttggtgagcaggtgaacgctgcatgtgtcaatggatgtgaatgccaagaagaaaataactcaggaaagaggagggggaggggctgggcgaggtggctcacacctctaatcccagcattttgggaggccgaggcaggcggatcagttggggtcaggagttcgagaccagcctgtacaacatggtgaaacccctgtctctactgaaaatacaaaaattagctgggtgtggaggcaggtgcctgtaatcccagctactcaggaggctgaggcaggagaattgcttgaacctgggaggtgaggttgcagtgagctgagatcgcgccactgcacgccagcctgggagacagagcgagactccatctaaaaaaaaaaagagaggggagagggagtcagggaccgggagggaggattgtggttgcacacaggatggtcactccaggggacatttggaccaagactgaggggagtgagacagcctgaggggagtgaggcagcagacagtaccattagctcaggagcatgtccaaatagggaagtgcgaggcaaaggtcctgtggccagagcggctgagtgcaggaggaacctgcgggccagcaccgcttctgcagggtgagagggtggaagccaggtggacacaggcttaggaagggagtggcggctcagcacgtcctcatctcccatggtagggccttgtttggcctctcagctggagacaggaaggcctgggagggttttggtggaggtgtgggctgaattaatttttttttttttttgaggcagggtcccactctgttggccaggctggagtgcagtggcgcgttctcggctcactgcaacctctgcctctcgagttcaagcgatcctcctgcctcagcctccagggcagctgggattacaggtgcatgctaccgcgtccagctaatttttttgtatttttagtagagacggaatttcaccacgttggtcaggctggtcttgaactcctgagttcaagtgatttgcccgcctcggccttccaaagtgctgggatcataggcgcgagccaccgcgcctggtgggctgaattaacgtgacaccataaaacgtctccgccacgggtggctactatcctgagagcagactgtggggtggcgggggaggcaggagaccaggtgggagtctctgggcctgctgcaggtggctgcgatcagggtggtgttgggggtggctggattctgaatatatttaggaggcagaggcggcgggatttgatggatttgctgtggggtgagagagagtgaatcatgggtagctcccccagctgccttctgtctgatctggggagacgctgggagccaggtggccgaggcggtcgaggcctgggttgtagtgagctgcggggagcccgcactgccacagcagctgcacctcctctaggccctgtccttggtagaggctgtgagtggcccgtaggaggtcatggtgacctccatgagcagctctgtttctgtctgtggttcaaaaggatgggacccagtaagcagccttccagaaaagtccactgtgccccaggtcagtcatcagacagagccatttcaagaagcaaatgacttggacaatgggggctgatgcttactgccactggcaaagaattccgaaaggttctgaggggtttactccgggcactgagcatgctctcttccaagctgggagaaaagcacttacgagtttttttctttttttttttttttgagacggagtcccgctctgtcgcccaggctggagggcagtggcgcgatctcggctcactgcaagctccgcctcccgggttcatgccattctcctgcctcagcctcccgagtagctgagaccacaggcgcccaccaccacgcccggctaattttttttgtatttttcatagagacggggtttcaccatgttagccaggatggtctcgatctcctgacctcgtgatccgcccgtctcagcctcccaaagtgctgggattacaggcgtgagccaccgcacctggccgagttttttcactttcccagggtttccgtgtaaatactacacaattaccaaccaaatgtctgtccttcctccgtttccataaatgtcaagggctccactgtaagggggaagcatggacccccactccaggaagacttcctggacagaccccacccaggcacctgctgaccgggttcacttccaaatcaggatactggcttgtcctggtttgtccatatttccccggtttcaacctcgacagtcaggtcacccctacctccagctaaccctcgtgccacaggcttgttgaaagttagatggcctcattttagaaaaacagatttaaaaacctcattcgtgtttgaacatggaaagaaagaataagaaagtaggctttatggccctgggctactggcttgaaactttggaagatatttttctttcttaaaatgtttttatgtttaggagatatgttctacatgcacatagcgaacatcctacccaataggcagtttttcaaccctcacccccgctgccatcctcccaacttttggagtctccaatgtctattattccatcctgtgtgtctgtgtgttacccattgtttagctcccaaagaagagatattatatatatgtacatatatatgtgtgtgtgtgtgtgtgtgtgtgtgtgtgtgtgtatttttagaggcagggttgtgatctgtctcccaggctggagtgcagtggcacgatcatggctcactgcaacctccacctcccaggctcaagcaatcctcttgcttcagcatcctgagtagctgggaccgcaggtgtgcgccaccacagtctgctttttttttcaaactttttgtggagacaaagtctccttgtgttgcccaggctggtgtccaactcgtgggctcaaatgatcctcccaccttggcctcccaaagtgctgggattataggcatgtgtcatcacgtccagcctccaaagaagagcaaattcactttaaattaaattaattaattaattaattactttttatttatcttttttgagatggagtctcgctctgcggcccaggctgatgtgcagtggcacaatctcggctcactgcaacctctgcctcccagattttaagtgattctcctgcctcagcctcccaccaccaccatgcccggctaatttttgtatttttagtagagatggggtttcgccatgttggccaggctggtctcgaatccctgacctcgtgatccgcccaccttggcctcccaaagtgctgggattagagttgtgagccactgtgcctggcccaaattctctttttaaagtatctgggctgggcgtggtgactcacgcctgtaatcccagcactttgggaggctgaggcaggtggatcacctgaggacaggagttcaaggccagcctgggcaacatggcaaaccctcttctctactaaaaatacaaaaattagctgggcgtggtggcaggcacctgtcatcccagctacttgggaggctgaggcaggagaatcgcttgatcctaagaagtagaggttgcagtgagccgagatggtgccactgcactccagcctgggccacagagcgagactccatctgaaaaaaataaaaataaatgataaaaaattttaaaaagcaattctgccaggcttattagaaaatggaaacaaggattttgtcatcaacttgctgcctcatagtaacaacaaaggtgtctgaatctgtaaatagttgtgtcttctttttttttttgagacggagtctcgctctgttgcccaggctggagtgcagtggcgcgatctcggctcactgcaagctccacctcctgggttcacgccattctcctgcctcagcctcccgagtagctgggactacaggcgcccgccgccccgcccagctaattttttgtatttttagtagaggcggggtttcaccgtgttagccaggatggtctcgatctcctgacctcgtgatccgcccgcctcggcctcccaaagtgctgggattacaggcatgagccacggcgcccagccaatagttgtgtctttggtgaaaacattctagaagttgaacgtcatctgtttataataaatgagtcagcatgtggtcctccaagaatctcgtctgctattgtcaccccatttcccgggtcctgtttataaatggggtatgacaaagggaacccacttcaagctgaaatcatctgttgttcaaatcctggattatagaaaggctttttcacttatgatttcagtgaagcaaaaggtcatgttatcatgactgctttataggaaatggatttcttaaccttctaaaacttttgaaaattcatttttgaatgagtaatatgtaacacatggcctgacagtaaatcccaatccacgttatggaaaaaccgacttgactgaataagcaggcagtccattgtttctctgtggttgtgttcttttctctggcttctgtgagaaataactgaatgacgggtaaagccttttaaaagtcaggcagtgtggctgggcgcggtggttcatgcctgtaatcccagcactttgggaagtcgagacgggtggatcacgaggtcaggagatcgagaccatcctggctaacatggtgaaaccctgcctctactaaaaataaaaaaaaaaaattagccgggcgtggtggcgggcgcctgtggtcccagctacttgggaggctgaggcaggagaatggtgtgaacccgggaggcagagcttgcagtgagccgagattgcgccactgcactccagcctggggggacagagcaagactccatcttaaaaataaataaataaataagataaaataaaataaaagtcaggcagtgtgtaacaaaaggaaataaagaaacttcacctctttagtgatcaggaaaatgcagattgagaccaaaatgaagacacgtttcactctgtgtgcccggtagaaatgaggaagcctgatggctttcagtgttgacagaatgtggaccacaaaagcccctcacacattgctggtgggccgataagtggtacaaatgccttggaggcagtttggtcttttctttggtgtaaagttgaaattcacatacttcggctaggtgcggtagctcacgcctgtaatcctagcactttgggaggcctaggcaggcggatcacctgaggtcaggagttcaagaccagcctggtcgacatggtgaaaccccatctctactaaaaatacaaaaagtcagccaggcatgatggcatacacctgtagtcccagctactccagagactgaggcaagagaatcgcttgaacctaagaggcggaggctgcagtgagctgaaatcgcagcgccactgctctctagcctgggtgacaaagcaagactccatctcaaaaaaaaaaaaagaaattcacctactcgaaaccagcaataccgttcctagtattgctgatgttcacacaatcatgttcatagcagcactctcatagaaaaacctttacacagcacaaatgcactttgacaggaggataaattattcttagtatattcacacaaggcaatattataaataagctacactcaaatagacagcaactctcaatattgttgatgactattaaaaaatcccaaaacaggccaggcgctgtggctctcacttgtaatcccagcactttgagagacggaggtaggcagatcccttgaggtcaggagttcgagatcagcctgcccaacatggtgaaaccctgtttctactagaaatacaaaaattagccaggcgtggcggtgggcacctgtaatcccagctacttgggaggctgagaagggagaatcgcttgaacaagggaggtggaggttgcagtgagaggagatcgcgccactgcactccaacctgggtaacagagcgagactctgtcttaattaaaaaaaacaaaaaaaagcaccaggcatggtggctcacacctgtaatcccagcactttgggaggctgaggcggggggatcacctgagatggggagtttgagaccagctgtcaagaaacccgtctctactaaaaatacaaaaaaattagctgggtgtggtggtgcatgcctgtaatcccagttacccgggaggctgagacaggagaatcgcttgaacccgggaggaggaggttgcggtgagccgagattacaccattgcactccagcctgggcaacaagagtgaaactccgtctgaggaaaaaaaaaaaaaacaaaacaccaaaaaaccaaaaaccaaaaacatcaaaatcattacatatggtaaggtactttttatttatttacttattgaaacagggtctcggattgtcacctaggctggagtgcagtgactcactgcagctttgacctgccaggctcaagcaatccccccacctcagcctccccagttgctatgactttaggtgtgtgccaccatgcctggctattgtttttttttttaatagagacgaggtcttgccatcttgcccaggctggtcttgaactcctagactcaagcaatcctcccgcctgagcctctcaaagtgctgagattacaggcatgagctaccatgcccggcctacgatactttttaaaataaaattaaaacaactaaaactaaacaatgctttttaggaatatatacataataaaactatgtatttttacaagattcaggataatggttacttccatttgaagggaggcagaagcagaggatgggggaatatacaaatacatgtcacttaatgtcaataattgagatgtcaattggctgatggggtcatagttgtctgttatattaaacaaacaaatacaaaagagggccattcagggatcagtgatgagagcctgagatgaggcgaggactgtgattgctcccaccctctctacctgaggtccagaaagcaagaaagaatgaagagttcccttttgacctgttacaagatcagcagtttcctgggtgcggtggctcacgcctgtaatcccagcactttgggaggctgaggcaggcagatgacctgaagtcaggagttcgagaccagcctggcaaacacagtgaaacactgtatactaaaaatacaaaaaaattagctgggcatggtggcacgcacctgtaatcccagctactcaggaggctgaggcaggagaattgcttgaacccgggaggtggaggctgcagtgagctgagatctcgccattgcattccagcctgggcgacaagagcaagactctgtctcaaaaaaaaaaaaaaaaaaaaagaggatgaagcaaatatggtaaatatggtaaaatgttaataactagtgaagatatatggagattctttgtactacttaaaaattttctaaatttgaaattacgtcaaaatgagaagttaaaagagaaatgacaggtcacttctccagtcatctcccaaccttgatgcatttggcctttttttaaatttttttaatttatttttttatttttttgagatagagtttcactcttgaagcccaggctggagtggaatggtgtgatcttggctcactgcaacctccgcttctcgggttcaagcaattctcctgcctcagactcccgagtagctgggactacaggtgcctgccaccatgcccagctactttttgtatttttagtagagacggggtttcaccatgttgggcaggctggtcttgaactcctgacctcagatggttcacctgccttgtcctcccaaagtgctggaattacaggtgtgagccacggcgcctgacctcatttggcctcttctttctgttgctcaaacactcaagacttacgactcagggcctctgcaagttccccctgcctggagcagtgatagggtgactctttaccagcaatatgaggatcccatttgtttggatcatttgtaaaggtaacttttcccatttgtaactaaaaagttatctgtggagggatcctttgcagtcactcacaaagtgtgaataaaatatcctgttcccaataatctttataaaaaatttaaaaaattattttatttcattttgtcatgtccttgagtcatagatatatacacacatatgtatatatatacacacatatgtatatatatacacacacacatatatatatacacacacacatatatatacacacacacacatatatatatatagagagagagagagagagagaatctcactttgtcacccaggctggagtgcagtggtgccatcaggacttgctgttgtctagaattcctgggctcaagcgatcctcccacctcagcctcccgagtgggtgggattacaggagggtgccaccatgcctggctaattttttaatttttaattttgtagaaacagggtttcactatgttgcccagggtggcctttaatttctaatgtaaacatttttaattgtggtaaatacacttataatttaccatcttcaacatttttaagtatacagctcagtggtgttaaatatattcagtgttgtacaaccatcaccaccaaccatctctagaactttttcatcctgcaagactgaaactctgcacccattaaacaataactctcattcttcacaatccccagctcctggcagccaccattctttctgtctctgaatctgactattctagggaactcatgtgagtggaatcttacaacatttgtctgtttgtgcctggcctatttcacttagcatcaagtgctcacggctcatccacgttgtagcatgggtcagaatttccatctttttggaggcggagtaatgttctgtgtgtttagtcacattttgtgtatccattcatctgttgttggacacatggattactctaccttctggctgttgtcaataatgctgctgcgaacatgggtctacaaacatctctttgaaaccttgctttcaattctttggggtgtgtatatacaaggaataatcttttatttcatagctttagcatctattgatgattcttgagtgaaacacttatcagagtgtccgtaaaatggctatttaccatttttgtcattctttccacatttattagttggcattcttttgtaaagaagctctttcctgcccatcctcccttttactagctttaatttcatcatcattattaatagtagtaatagtaccaatgtggactccgggatttttaaaattatgactgcatgtgttagaatccattcctgacatactcaattgatgctcaagccactcccagtttgggtgagaaccctttcaggctggctgctgtgtccttgacacgcccccttcagcttttgagctctgtcttaactcctgttccaggctccttgtgtccttcccagtctcggccttgggagcagccactcctccaaggatccctgggtactttcagtggaggatggtccttagaaggctggatctgggcttttgtgtgcctcttcttgctaccggagtgtccgtgtttccagggcgtttttcatggatggagctgggaaacattttaaaattgtaaattcaaacggatcagttattccagtccagcagcacagagttcttcctctccttcccccgtcccataattgtatctttcatttgctttctgtgttttccccaggaatgttgtcttcatcttgaatctcctttgctactggctgtactcattagcaacataaaattcctcgtgataacctctgacccctatcccatgtgtgatgacaccgagttgagggagatcagacattcaatgcagaggtgggggccaagaccaagcctcctggggcttaagaaaatatctccagagacgggaagtctggaagggaactccatcacgaatattttatgttccctccctctattgttctcaatcactgcacaagtgtatattactttttttaataacaaaaaggaacttttaaggtaaccccccacaaccctatatagactggatgtcaactctttagtcctagatacacctggagcctggcgtcgtggggacagaggcaggtccctgtgctgagggcggtaagacagggcgggtaggtggggacccagctgggaggtaggggggccagacgggacatcagctcccgggagccccgctctgggcacggtgcgcgcctccaccctccattgcaccccgcgcctgcttcctcccaggtgcacctcgggcgcctaagccagctgggtcccgggccccgggagcagctgcgggcccgacgggggcgtggcgggaccggcgggggcggggcctgggggtggtccgcgcggattggctgctgcctgcggcgcacgagccggtcagcgcgcaccccgcccttcccgggccgtgcggcacgccgcgttcacgtgctgtcgcgcgccctcccggcgtgcgccgcgcggccccagcctgctctgcggcgactgtccggctcgtgagctccgcgtggatccggcgctgggccccctacgctctggggacctggggttgtgtttccggcaaaggatgttttccgagaaggcctgggagcggctgtaaataatacccgagaggaaataggcccggcaggtgtttttgcgcgtcccggcgttgggtgtggctgcggcgggcgtgcaggccgcagatgaggaaacagactaggagggatttaggcatctggactctgcggggcggcccgggcgcgcagcccgtttccctgtgggttgagggcgcgggagaagtgggcggcccaccccaccccgcgcgtggatgcggggctggggcaggtccgcggtggaggcgccgccagtgagcacccggggaccgctcctagcccccagtgtgggacacagactccctgaggacctcgtatgcgttgggtctgtggctccatccgaatcttcatgaacagggcctgcggtgaatttggggagagtgagtgagcgggtgaagggtcaggaaataagtcacaggaggcatggttgaagaattggggatgtttaacccagacatggcaggactgggcacacttgacccctgtctggaagtatttgaaagacttctgaagggggccagcccctccacacctgtgggtgtttctcgtcaggtgggaggagatactgagaaaagaaataagacacaaagtataaagaacagtgggcccaggggactggcactcagcatacgaaggacccgcactggtggccgtctctgagttccctcagtattgatcattatttttactatcttggcgaggggagtgtagcagggcaacaggtggggagaaggtcagcagggaaacatgtgagcaaaggaatctgtatcatgaataagttcaaggaaaggtactgtgccctgatgtgcacataggctaagtttatgtttccctttactcagacatctcagtgtagcaaagagtaacagagcagtattgctgccagcatatcgcctacagccacagggcggttttctcctatctcagaatagaacgaatgggattggtctgctttacaccgagacattccattcccagggatgagcaggagacagaaggcttcctcttatctcaactgcaaagaggccccctctctttcactacttctcagtacagaccctttacgggtgtctggctggggcacggtcaggtctttcccttcccaggaggccatatctcaggctgtctcagtggggggaaaccttggacaatacccaggctttcttgggcagaggtccctgcagccttctgcagtgcatggtgtccctggttaatcgagaatggagaatggcgatgacttttaccaagcatactgcctgcaaacatattgttaacaaggcacatcctgcacggccctgaatccattaaaccttgattcaatacagcacatgtttctgtgagcatagggttggggctacagttacaggttaacagcatctcaaagcagaaacaatttttcttagtatagatcaaaatggagtttcttgcgtcttccttttctgcatagacacagtaacaatctgatctctcttttccccacaacttccttatgaggaagaggctagactttccttctccctgggggcacaaaacagattttcccaggtggagaatttcaggtcagttacacagagccggcagggatgaacatgtctggcgttctttgcaggagccagatgtttacctatgttagtgggagaatagtggagctcagatgcaagttctcatctgccagactccaaagcccttgccttttctcgatgcgtctatttttttgtaaatgttttagttcagaggtacatgtgcaggtttgttatataagtaaactcgtttgttgtagattatttcatcacctaggtataagcctagtacccagtattttattttcttttttctttgtctttgtttttttttttgagacagaacctcactctgtcgcccagactgaagtgcagtggtgctatctccgctcactgcaacctctgcctcccgggttcaagcgattctcttccctcagcctcgtgagtagctgggattacaggcgtggatcaccaggctcaactttttttttttttttttttgagacgaagtctcactctgtcatccaggctggagtgcagtggcacgatcccggctcactgcaacttccgcctcctgggttcaagcgattctcctgcttcagcctccccagtagctgggattacaggtgccccgccaccacgcccagctaatttttgtgatttttagtagagataggctttctccatgttggccaggctggcctcgaacacctgagctcaggtgatccgcccgcctcggtctcccagagtgctgggattaaggtgtgagctaccgtggtagagatggggtttcgtcattttggccaggttggtctcaaactactgacctcaagtgatccacccgccttaggctcccaaagtgctgggattacagacatgagccaccgcccggcttagtatttttttttttctgagcctcttcctccttccactcaatgcatctattttagtggaatgggttcctttgtgaacaatgatgttgcagttattcatgaagtaataaagtgtttgtgtattgattgatttctttggactggagggtttgcccagccctgttgagctttgtcattgtctacctcaggggaagagggagattgtcgctggtcagaggagaatgccagggcttctctcagacggaggcagcctcccatctcaccgcaagtcggatcttgagtagcacctgtttcggcccattgcccctttaacaaggggcccaggtgcccttggacttgctagaagaataatcatgactttgagtttaacaaatgtggtcacagtattccactgcagtccacctttcccacttctcctagcccttcttcttctttttttttttttttttttttatttgagacagagtttggctcttgttgcctaggctagagtgcaatggtgcgatctcagctcaccgaaacctctgcctcccagtttaaagcaattctcctgtctcagcctcccgagtagctgggattacaggcatgcaccaccatgccctgctaattttgtattttcagtggagatggagtttctccatgttggtcaggaactccccatctcaggtgatgggcccgcctcggcctcccaaagtgctgggattacaggcgtgagccaccttgcctggcctcctagcctttcttttttgcaaatctgacactcctcccctccaccccatgtgcctagacaaggccagcatgggactcacacaggaagagctgaggactggaggagtgagtaacttttacctgagtacgtttcagccctccaggtggtaccaggtacagtcctctgagaagtcgggaggaaaacgcctgtgcgggtctcattcagctctgcggtcctcagtgtctgtctgatactgagtctgtagtgaggatgcataacggggtaaccctttctgagctcctggattcatttgctgaattaatagcttcatactctctgaagagaggaatactttaggagtctcttttttgtttctgccacatttattaaattgtcacattttaacacattttaagccattttaacatctcttgagagaaggtaggggctgtggaatgtgtataaagagacaatatcttgtttttcttggatccctagctagcagatgtgattacagtttcttatcaagaactcagccagaaaataccagccaaaccctcttcctccattggattatctgaggcagcattcgtatctggtggcctctctgctctgagcagtttgtggagctccagaagatgtctctgatgatcctcttttcttcctttcaagggatttcctagattattcatcctaaaccttggtctcattcctctcctacgcccttaggtgttaaggaattggatatctatggagatagccagcccagccctaagcgacactgtagagaaggttaaattttgtttctctttgcctgtttctggtcctttgtcccttgctaagtccctaggtcgttcctgcttttttctaggtcacatcctcagcttcttcatctgcgtcatctctaaatgacagatagtagctcagtttgcattttaactgatagctgagatctttaactccagagatgctatctaaccatttagggacaggttaaatcacattgtcttctttccctagcctgccccactctccaaccccagcattttcatacagaggggcagcttaggtaggggtgactagaggtagtgggaggctggtggaagatcatgaggtagtgagtcctggaatcctccactttgctcccacttgctgagcgagggccctggccacccacactgaccatgcttgtattcatcagctgtcctagaatgtcctgcctcaggctggaggctgaggatgccagtgagcgaggcagaacggtggcttcagtcagccttcctgggttctgatgccacctccaccactgagtagctgtgtgaccttggagaatttcccaaacatctctgtgcttcagttccctgatgtgtcagccttatgcagttgtgaggattaacacgagcagctaagcacaaaaggcttctacatggcctggtagaaaatcaggatgccaccctgctggtggccactggaaaccctattacaatccagagtgcttcctaagtgggccttattattcctgtcttaaaggaactttctgcccagcaatgacaacttggccattgctacgaccattatgcatgagtttaacggaccagaaaatgggatggggtggtctgcacagcagctgcccactcgcaggtgccgagtgtatttgcaggtctgtttgagcccttacattcaggcctggggatggatgtgggtgaatgtgcgcgacaggagcgaggcagccccagtggtctgacttacattcaaagcacttcacggaatccatctgcccagacaacctcctaaagtggtccttcgttgaatgcctctcccgtctgccccccgaaaagttatctaaaagtccccactccttatgctttctctttttgagccagagtctcgctctgtcacccaggctggagtgcactggtcactgcaacctccccctggttcaagcaattatcttgcctcagcctcccaagtagctggggctacaggcatgtgccaccacgcccggcaaattttttgtatttttagtagagacggggtcttgccatgttggccaggatggtctcgaactcttgacctcaagtgatccccccgcctcagcctcccaaagtgctgggattacaggcgtgagccaccgcgcccagtcttcttatattttcttgtcacagtgcatctgcttgggtggcaggtgcacctacctgggggagagcacattttctgttcttttcttagtcttacgcagggaggattgtgattgggactctggcggctgtgagcagggtagggggtcttaattttagtgagcaaggggcacgaatgctcagacctgggccaccatggagttgtcggggtgtgggtaggagactggcgtcacccataaatgcagagtagacccacttcctccaggatatttgactgtgatcttgggccattgtgtctgttccccaggccctgagggttctcctgggataagatgggtatgaacttgctgcgctgatggtgaaggcgggtggctgaggaacaggaagagtgcgtccagtactgcttaagaattcggtgatgtatcctgggctctctagaggcttacaaacatgtggaatctaaaagtcactcagaatttggaactctctaaatgtttatgtcccagggtgaaatcccagccctgagctctatatatgggagtggccaggagggtctgagcaccgaggaaggactggcttctgcctggctcccggttttatgtttccctaacattgttatgtcttggatgtgtatttccttaaacctttcccaggttccttttggttctgggtctaggacactgagaagattgaaacattgggagtgcactggccttgctctctggaaaggctttacttttcctcttgcctatttgcagttcccttaaattagtcacattttgggaccctcttttgcattgaatttctgggacttctgtttgtggttattttgaagtgggggtgggaggacatgcctgggcccaccccgtggttctttaatgaagacgatggttttccttttaagcaaaagaaccttgtttaccattaaccagaactctggaaatagatatttaatccccaaacagaggtgatggtgtgtctagaagcaatttaaagcctccatagcttgactagtcactttatcctgggcaactttttggattgtttggtaatctagaaacgagagagaacgctaattgcttcaacattaaagaaacccaccttctagactcactcgttcccccacccctcctttatgttttctttcttgttcctctaagaaatgaaatatagaagacgaaaatataaactggactacagcagggtgcagtggtgcatgcctgtaatcccagcactttgggaaggaggattgcctgaggccaggagtttgagactggcctgggccacatagacctccttcctacaaaaaatttaaaaagtatatttaaaccagactagaaactttcaaccacaaaaatccatggggtcattgaggtgcaaatggaaagaccaggagcaaaagtagagggagcaaaagtagagggtggggacagtgtggaggtgaggacagtatggaggtggggacagggtatggaggtggagacaatgtatggaggtggaggcggtggctgagcagagcaggaaagctgctgggggctgtgaggagctaggtttggctgggtgacagcaagggctggacagaaagtgctttcagaaaagcccaaggataaagtccaaagagattaaaggttaaaaaaaaaagaaaagctcaggaagaggaagatgacaggtccccaggggaaatctgcctaatccagcagctgggaagacaggataccctcaggcccttccttagggcaaaaggattactccgtgcaggaaggaaatattacaaagtctttcttctctattttattattattatttttttatgagacggagtttcgctcttgttgcccaggctggagtgcagtggtgcaatggtgcaatggcgtgttcttggctcaccgcaacctccgtctcccgggtgcaagtgattctcctgccccagcctcccgagtagctgggattacaggcatgcaccaccatgccaccacgcctggctaattttgtatttttagtagagacgggatttctccatgttggtcaggctagtcttgaactcccgacctcaggtgatccacccgcctcagcctcccaaagtgctgggattacagacgtaagccaccgggcccggcccttcttctctatttttaactcatcttttaaaattgttctttctttcttttttttttttttggagactgtctcgttctgttgctcgggttgaagtgcagtggcgcgatcttggctcactgcagtctcaacctcctgggctcaaggaatcctcccggctcagcctcccaagaagctgggactataggcgtgtgctgccacactcggctaattttattttttgtagagatgaggtccctctgtgttgctcgggctggtctcaaactcctggactcaaaagattctcctgccttggcctcccaaagtgccaagatgacaggtgtgagccaccactgctggcctagatatctattttttatatgaaatttctatcatgtacataatgtgttcgtgcaatagcacatgtatattagatatagataaacaggttgttgggggtagaaaagtttggatatcagatcagaaaagtttggatatctcagctcagagccacgatgagagtggggagggagcccgcgcttctcaagctcaaatgcctaggagtcctttggagatggcgttcagatgcagattcttgttccatagatctggctggagcccaaagttctgcagctggcgggctgattcagaaaacatgagttggtgcttttcctctttttgccgccgtactccattgagagtcttagtcatggagggaaacccgaaaaccaccggtgtccgggacagatactctgacgcattctcccggaacaccctggggactgcgagaaagcccctgctggctcactcgtttgctgggatcagttcccatcaggcatgcggctgtgcttcttggtatcgatttgcttcttggtcccatggcttctgcagcccacgtcgggagggcaaggtgtggtgcagcctgagagaagcatgctcctttgcaggaaggagagggaggcgcacaggcgggccttttggagcagaggaggcagaggagtccaagctgggtgcagttcctctgctgcagccctgagctgggcagacaggacacttcgctggcctttcctggcctcatacttgtcactcggtgacactgcgaccagtgtgagcaaacgttcagaaagcacatttaaacactgttacttaaaattgcaacttcacagggccagtattctttttaccatgttccaaatgaggaaaccggggtgctgaatgattaagtgacttatccaagaccacagggcttgcaaatggcaagtgggaggattgtttgagcccaggaatctgagaccagcctgagcaacatgatgagaccccatctctacaaaaaattaaaacattagctgggtgtggtggcgcatacctgtggttccagctacttgggaggctcaggcaggaggattgcttgagcccagtaggtcgaggctgcagtgagctgtgattgtgccactgcactccagcctgggccacagaacaagacttcatctcagaaaaaaaaaaaaaagttcacccaaggcagacaacttgtccagggagggcagagctagatgttcctgtgactgcagtgctggggcgcatctgtcctctgtcctgaaagcaggccgctccatgctcatctcccacaccttcacctcctgttaggccagcgtccactgcagtggcccagctcttcccagcatccccttacacaggatctgtgttcccttcatggtttggcctgcatgtccttcaacctgggacgtccactctctctcagttctgtcctcattgtgccctacttgtctacttcgggaactctccttcaccactcacctcacacccttcctccaggaagccctccctgactttctaggcagagttggagccctcaccctgggcatttccacagcagaaactgtcccaccacagccgttgctggtggtcatgtttgtgtttgccagcagcccacaagaggtcgaggcgcaacctgtagtcctcagctgctggggccgggcagtggtgtgctttcagcctggagggggcgctcaggaagaggttgtccacttgtgtgcagcttttatgtgtcctgtgcatatggttacagcaccgcttcctgtgaaggagttgagctaggggttgtgctgaatgcagagaacaagatacaaacttaaagaggcctagggtgtggcgggaaacacacaccccttcccccacctatatatgctcacgtgaaaaggtgcagacaagtatttgaggtagtgcagaaaataaatgcttggagaacagcaagggagggatgttagtagacacagagggaatagacagaggcaaagggggtttctgggtctccagagatctggggggctaggtgcaggaaggctttttttgggagagaagcagatcagctgcgggggtgcagagagagggaggggaaaggttgcttgaggcctcattgtagaggaccttccgtgaagcctaaggaggttgaacttggtcttagtggcagtcgggagccagtgattgtttctgagcaggggaagaaaaccaaagtactgtcttaggaagatgagtccctgtcagcggaatgcgcagtggacgcaaacgggaggcggggaggaagagatggggagtgagggcctgtggtccaggtgcggcatttagaatttaatccgcacagatagtaggcacggaaagaacatagatgatgtgtgcgggagttgagatttggggattgaccaggtgtggggattggagcggcttgaagaggcaagttccagtagaaggagtcattagtccttacacggtgctccttactccaaagcctgtattttttctgctgacttctctgagccttagtctcctcttctgtaaagtaacgggcttggatctcttgttatttgttctggactcctggcacagatctgctggttccttcatgccaatgacccaggcctgtttaccaggagaagcagacatcgtgacctttcccgtccagccttacagcctagtttatcaatccaggacaggggttcttagaagagtcctctctggtaaacaataaacaagtgctgttccgtctgcctcgcggtgcccccacacctgcctggccacgtcacactggcagatgggacgcgggcatcagctcaagttctgtggagcgagagattccgtggcccgggctgacctgggcttggaggcctggagctgcctgcggcccccgccgagaaagccaggagctggggctcgcttgtcaggcgtgtttctgtttctgtggcactgggcctgctgcccctggactgtggagacccagtgactggcgcagggtgagagccagggttgggaccagtgtgcgggcacaaagccccagaggaaggtgcgctctggtggctctggccctgtgatctccgtgcagccctcccacggctctgctgggggaagctctggggtccctgtgtgtgtaaaaactctgggcctgaggaatagcttctactttgtttctttctttaattttttttttttttttaatacggagtctcactctcatgtaggctggagtacagtggcacgatctcggctcactgcaacctccacctcccaggttcaaggggttctcctgccttagcctcccaagtagctgagattacacctgcctgccaccaggcctggctaatttttgtatttttattagagatggggtttcaccatgttggccaggctggtcttgaattcctgaccccaagtgttccgtgcgtctgcctcccacagtgctggggttacaggcgtgagccagtgcccccagactgttttgtttcttttctttcaaaattaaattgtccccagcttctctcctcaaacctcagttttaccccctctttggttcccatgcacaagtagagagaatatgaggttgtcatttcaatggccattatgaccagaaaattgtgagattgcatctctcagtcttgctccgtcccctctcttctttccctcctttccatcatggcactttggggcactttcaggtacacagagtgttggcaataacagtaaatatcctgaggtggggagcacttggatttgcctggcatggattgcgtgtttgtaggtgggaactcatccgagtgtggggaccacagtgctgttgtcatccccgtatgacagatggcacagctggggcaccgcaggcgccaactagcccggatctctcactgaccagcgctagggctgcaataggaacctggctggctggctccagggcccgggctcttatccgggaacagtgttgttcttatttgcctagatcaacaaagtcactgtagagaaagacaaaaacaaaacaaaatccaaaccaagtaagccaaaaaaagcttagcctggggacccagttctacatttggtggtggtcataaaagaggctacccaaatggcccgtaagcatagaaagcacttcaacctccctaattattcaagagatgcaaattaaagccacggtgagatactactccacacctgttttagttagagtggctaacaagaaaaagaccacatgttggggagactgtgactcacaccaactctcatatcagagtagaaatccatacaatcatcttggcagcatttaccagagccaagcatctgcacacagaaggatccaggaagcccccgccttggcgtagacgcatgcactcaaggtgcacagaagaatgttcactgcggcaccccaacgggtgagagcccccaaacggaaagaatgcaacgttccatcagtgtggagaagtcaagtgtggtgttcgtgcagtggaatactacagaaggatgaagaagaaccagctattgcaggaagggacacggtggaagaatcttatggggaaaatgctgagggaaggaaaccaggccaagtaaaacagatagaaagttcaagaccctgcagatcgtctgtatccgatgtcaagacatgggttcccttgaggtggtgatgggagggggcacgggggtttctgtagcgacctggttgatgggtgggggttgcataggcatgctttcctgtgaggatcgtcgagctgtgcattctgaatgtattctatacttctcatttacctgtttaattgtgcaagagatggggtctccctctgttgcccaggctggagtacagtgggcccatcatcgctcactgcaacctcgaatcctgggctcaagtgatccacccacctcagcctcctaggtagctgggaccataggtgtgcgccatcatgcctggctaatttttaagttctttgttgtccaggctgttcttgaactcctgggctcaagcaatcctcctgccttggccacccaaagcactgggattacagacttgcaccaccacacccggcctccatgttatatttccataatatgtttatttgaaaagtgacttgggtgccaggagacatgggccctccctagtcctggctgtctctaacttgtgagtgactcaagctgtctccggttccactttctggaagactaatggcttggatgagatcgtggttttcagatctgtcctagccacagaaccctctcttcaaacaagcccttacctgcaatctgaacataaaatgctacctggtgggactcacgagtgagttccggacaggacaggagacggctgtcactgggctccaggatgtgggtggcagtgcctgacttcccgctcctgcctgctgtgggagacgagcttcttgcactggggcctgatttcccaggctggcctctcagatcctgtggcttcaagttctcctggtcatgcagtgtcctggttcagcactgaattgttccctaatggtttcctgtgtggcagattccttagctctacagtgaactctaacagggtaggcttgaccggcttctgtggtttgcttggagtagttaggatgaaaattcagaacctgcctgctgactgaaatgggcgttcatgtcttagaatgctcaccagattgctttttctcttacacatagtagaggtcaataaaacggagtttgtgggatgtttcttttcttttctctttctttctttctttctttctttctttctttctttctttctttctttctttcttctttctctttcttcctttcttttctttctctttctttctttctttctttctttctttctttctttctttctttctttttcttttctttctctctctcgctctctctttcctttctttttcttttttttttttgagacggagtttcactcttgttgcccaggctggagtgcaatggtgcgatctcggctcactacaacctctgcctcccgggttcaagcaattctcctgcctcagcctaacaagtagctgggattacaggtgcccgccaccatgctgagctaattttgttttgtatttagtagagacggggtttcaccatgttaggctggtctcgaactcccgacctcaggtgatctatccgccttggcctcccaaagtttgggattacaggtgtgtgccaccgtgcctggccaggatgtttctgatgcagggataaggtggggaacttgggaaatggtgtacaccactgacggcctggggcacatggggtggacacactgggagtggatacctgaggtgggcacgtggggtggacacgtgggtgtgagtggtcacctgaggtgcacacgtgagggtggatatcatgagggtggctgtcaagagggtggatgctggttcagggctggcatgaagaccctagtcaggagggagccaaggcgtccaaggaggccctcaggctgcaagtgttggtttggccccagtcttggtgatgacaggacctttgggaatctgaagcccggtgaccttgggctgtggggagctggcgggctttatctgcccagcgtctctgccccagttttgggcctgtctgtgatgctgggcacctgctgatgtgcgcagcttcattcattcctcctccactcacccacctgaccactgtgtggggcgcccctgctgtgggccaggctggttccagggtccatcagcaacagaaacaaaaatgccctgtcctcttggggagacacaaccagcaacaagagaacagcgaaggaggcgtaggacatgcggctgatatgggcttaggggaaacgcaggcaggagagggggctgcaagctcaggcgggagctttggggccaggaaggcctggctcagaggggacttgggtcagggtcacaacagggaggtgaagccactgacccggagctgctggagagcttccgggatggacagagtccgccccacgggtccctcctgccctccctcggtgcctgccctgggccgtggagatgactggggagcagctgggcgttattttccccggggccagggtgggcatctcggcctcgagttgatctgaaaggatttactgctgtcagagccaccccatcgtgtgcagcacggactgggggggatttgaaggcagagggcctggggtgtgtccagccccacctgcccctcggccccaatctgcttctggagagtggcctggctgagccgggacgcagcgcactggtccctaccttggaggcctgactcccttgagaagtgtccccaacccagttcccgtctcactaccagccaccacctccccagcacggggtcctccgcaggtgatttcatctctgaggcggctttcttatctctggaagagcagtactatctccctggtggagtcgttctaaaaatgaaaggcaatgtgttcaaagtgcccaacacgtgcctgccgtattcaataaaagggagctagtattcatttaacagctgagaagaaaaacagtgaacacttcttgagctctgtttatctgccttgttttactggaggagaaagtggggcacagagaaattcagttattggtccgaggtcacacagcgtgtgagtcgggaaggaaggggcagctggaatttgaacctggcagtctggcttccctctggggaagagcagtggatgagggcgaagccgacaagagcccaaactcatctgcgctgcgctgcttttgagccacacaaatccaaataagggatcatccaaatcctttattttctctcgaagttttgtgatcattaatcagttaacagcttgttcccttctgtgctggacaacccccagctgcaaggggcaggaatggagcatgggggaggctgtaaaatagatcactcaggcgtttccctagcgagccccccgggaatgaacagaagggtttctctcctatggtgggatgttgctgtccatgggggtcgtcgaaggacgggtgtggaggcccaggaggactgcaggcaagaggggagaaaaggaagaacccgtctcccctcaactggatcatcatgggctgtgttgcactggtaaaccaaggtgccaaggctgcggcagctcagatgggaaggggaccctgttttctgagcatgcagacgccaggattataggacattctgccaggcacagaaaccacgagagcccaccttccccaaaggctgctggctccaaagtggggagggagtggttgttcccaggtgataagtgatgagaagaccgttgagcccccagagtgacacccaagcatgtaactaactcgagaccaggagcatccactgacaaacgcccggtgaggtcgatcctggtgacaggatccaggtgctagtcgggtcctgagtcgagttgctggactcgcagcatttaaccattcaaaataaccagctttaaaaatgtgtgtgggccaggctcggtggcgctcgcgtgtaatcccagcactttgggaggccaaggcaagaggattgcttgagcccaggagtttgtgagcagctgggcaacatagtgagaccctgtctctaaaagaaaaaaaaaatgctgtaattgacattctttttaatggatggatggaggaatgaatgaatgattgctttgcaagacagcatgaacctcaggttccagagtcaggcttaaagcaatcagattgagggggaccatgtaatattttttcctaacattaacaacaggcttattgtacaaaggacaggaaaatatgaagaaagaaatcattcataattacatagcagaatagccattgttaacatttcaattttcttcaagttttttcttttctttcctttggttttgttgctgttttgttttgttttttgacagagtctcccactttgcccaagctggagtacagtggctcagccgtggctcactgcagcctcaaactcctgggctcaaacaatcctcttgtgtcagcctcctgagtagctgaaactacaggtgtgcttcaccacacctggctaatctttaaattttttgtagagatggggtcttgctatgttgtccaggctggtctcaaacccctggcctcaagcagtcctctcacctcaccttccaaagtgctgagattacaggtgcaagccaccgtgccctaggttattttaatatagtttatcaccaatgtatgcaattctgtgttctgagtgctttacttttaatgacccaaactaagatgttctactctgtgtgttagttctctggcaagtagcagaattgtggtatgtgttcctaaaactaagatgtatcctgatcacgtgacagaggctgatacctctttaaaagataaagtttggaagtgaaacagagactagaacagatatttgtcacacccatgttctattttattttcatttgtaattattttagagacagagtctggctctgtcgctcaggctggagtgcagtggtgcagtcatagtacactgtaacctcaaactcctgggctcaagctatcgccccacctcagcctcccaagcagccagtactgtaggtgtgtgccatcacacctgactagtatttccaaaaaaatgttttgtagagataaagtcttgctgtgttggctctgctggtctcaaactcctggcctggagtgatcctctagtctcagcctcagtagctgggattatagtcatgagcctctgcacgcagcccacgcccatgtttatatcagcattattcacagtaacaaagaggtgggagcaacccaagttccatggagggatgaacagataagcaaaatatggcccatccacacagtggaatattatgcagccttaaacaagaaggaaatgctgacatatgctacaacatacatcagccctgaagacaatgttctgagtgaaataagcgagacataaaaagacaaatactggctgggtgcagtggctcacgcctgtaatcccaacactttgggaggctgaggcgggaggattggttcagtccaggagttcaagaccagcctgggaaacatagcgaggcctcactgcagggtgtggtgggacacatctgtgggcctagttactcaggaggctagggtgggaggatcacttgagcccaggtgctcaaggctgcagtgagccaagattgtgccactgcactccagcctgggcgatagagtaagactccgtttaaaaaaaaaaaaaaaaaaaaaaagacaaatactgcatgattccactcatatgcgatctctagaagaatcacactcacagagacaaagtagaatggaggtggccaggggctggggagggagaatggggagctggtgtttaaatggggacacagtttccattggagaagatggaaaaattctggagctggatggtagcgatggctgcataacactgtgattgtgcttactgccctgaactgtgtgcctaaagatggggaaaatggacaattttatgtatgttttgctacaataaaacaaaaagcaaaagataagagttggagctgaggtccctggcttctggcctcctcagtcttggcggattcttcctccctgtctccccaagttttctctctaatccctcacctggcttttctgggcaaaggccagcccgcttctcaccacccccttctctcttgcatatgcatccccccaacattcacacagaagcacgcacacacacaccccttgaggtctagactgggggtctgggtgcaggagggtctgagctgggagacctccccactgcagcagcagtgtcacaaacaagttgtcctgcacctaagactaatctggagtggaggctgggaaggaagcggtcctggtgctgccggcagcctttccatcctagggccgagctggctggggagaatgaggggcctttgaagtcccaggccgatcccttcgccagacctcccaggccaggtctccacgccagcactgtgtttcatcacaagtgcaaagcttccagcagagcagtaggtcccgagcgggagtgccgggatgtggcctcgaggcccccgcctgtcattgtctcccagcctcaggccctgttccccttctaggcttgtgccacaccaggctaagaatcagagcctgggtgtgggggcagggggagctggaggagcgggcaggactgcccagtgctttcctggcttagctgggcgaaatccaaatgcagtgaagttcgccttgcagtccagtgtccatggccagggcaggagggcagagggctgagcctctgccagacagagcagtgcccttcccagccccccagggtcttcacttgcttcacagagggtcagctggaaggactatggggccccacagacccacctgtcgccacaggttgagaacatggatggggcggtgcccagcacggtccctggctccaggacacagtgcacagccacagcccatacacgccccagccccaaacctaggagacttggtccttctgtgtcacacctctgttctccctggagttgcaggggattttctctggaaactacctagtagtttagggtcctaagaatttatccaatcttctttcagaagatcacccagttcttcattctcaaaaacaaagcacaaagactttgaacagctgcggaatggcttgtcataagccacacaggagaaaagtccgcaggcccagcaccacgccaactttggggttggcttattctagaatctagactatttttttgctcacaaattatctctaaaacacctccagctccactaggattctgtttactaactgcttcctgtgcacctgtctcatttcctcaacaaggaatagaatgcttgcagtcaggtgccccagccccaccagcctgaagctgggcttgtagctggcaccatggtaggtggcagtgaaaactggagtctggcctggtgtggtggctcatgcctgtaatcccagcactttgggaggctgaggcaggtgaatcacctgaggtcaggagttcgagaccagcctggtcaaaaaaaaaaaaaatatatatatatatatatgtatataaataatatataaataattacatgtatagttttgaaagcaggaattttttttttaatttttttttttgagacagagtctcgctctgtcacccaggctggagtgcagtggcgtgatctcggctcactgcaagctctgcctcccgggttcacgccattctcctgcctcagcctcccaagtagttgggactacagacaactgccaccacgcccggctaatttttttttatatttttagtagagacggggtttcaccgtgttagccagggtggtcttgatctcctgacctcgtgatccacccgcctcgccctcccaaagtgctgggattacaggtgtgagccaccgcgcctggcctcaaagctggaatctttacatgacaggcatgagcatcactggagatgctttttgttttttattttattttattttatttttgagacagaatcttgctctgttgcccagactggagtgcagtggtgccatctcggctcactgcaatctccgccttctgggttcaagtgatccttgtgcgtcagcctcccgagtagctggggttgtaggtgcccaccaccacgcccggttaatttttgtatttttagtagagacggggtttcgccatgttgtccagcctggtctcgagcttctgacctcaggtgatctgcctgcctcagctccacaaagtgctaggattacaggtgtgagctaccacacccagcctggagaagctttttaaacattgcacccccaaaagccccatcctggcaattctggtttaatcggtctgggatggggttgacacaatgggtagttttgaagttccttggtgattcttttttttattttgtattttttgagatggagtctcactcttgtcacccaggctggagtgcaatggtgtgatctcggctcactgcaacctctgcctcccaggttcaagtgattctcctgcctcagcctcctgaggaactgggattacaggctcccaccactgtgcctggctaatttttgtattttcagtagagacgggggttttaccacgttggccaggctggtttcgaactcctgacctcaggtgatccacctgcctcggcctcccaaagtgctggaattacaggtgtgagtcaccgcgcctggccttttttttttttttttttaagagagcgtgtttagctgtgttgcccaggctggtcccaaactcctgggctcaagtgatcctcccatctcggcctcccaaagtgttggggctacaggcgtgagccagcctgccggccttcctcatggctcttacgtgccacaggtattgaaagccactgatctccaccatggtcagacttagccatcagcttcgcacgttcactctttttctctccccagattatttaacaagttagcctggatctcaatttattgaaacccgacacaaaaaccctgatttaaataaccaggaggcccagttatttccatgaggacactagaggaagaagcactagggtgaccacggcacgccccacgagggcctctgtggccttgagacacatcactctctgcccacaaggactctcagctctttctctgctcctctcctttgatccctctgctgggggtggattacagaaagaactgctggcttcctccgtaatctctttacaaggccccttggggtgggccgttccgagctggttccactcatccgcttactcacagtggcaggagggttagccactaagctgtttatcagtcattgataacttcacatgaggcttacattcttttctgaaaacacgttttcacaaggatggagagaacacaccatagaaacaggccactgcgggggcgaggagacggcagagggacgccagggtctcccatcggctcacctctggtctcgcccctcttccaccgggtgctgctggacctgtggtccagccaggggctcatctgggtcactacctggcactcaggccctcacccagttataccagatcagtacttcctccccgctccttttttttttttttttttgagatggagtttcacttttgtcaccaaggctggagtgcaatgtgagatttcggctcactgcaacctctgcctcctgggttcaagcgattttcctgcctcagcctcccgagtagctgggattacaggcacccaccaccacgcccagctaatttttgtatttttagttgagacagggtttcgccatgttggccaggctggtcttgaactcctgacctcaggtgatccacctgcctcagcctcccaaagtgctgggattacaggcatgagccaccgcgcctggcccctgtcctccagttttaagaactcgagcccctctcccagtggtataaagtcttgctgatagggaagagcaggaaccttggtggcccagtagaactactggtgaccctggctgtcagagatagagcaaggccagaataggaaggtgattggtggtgttttcggtggtatatgatggagaaatgattagaaataaaactattttgttttttattttaatattaatattctaattagaaagtttgtattagcattttaatgatattcataatatacttcatagttagggatgcttttggctgtaagtaactggatactggaccagcagtggcttaactccatggaactaatcacacgaccacatcctgtggcatcctcagcaaaggggtagatgggcccagtgatgactcattcctgtggatggaatggaaaataactttttctgaaactgggagtctctgtctccctccattagccaatcaaggttcattcagctgagcagtgtggagtggtcgcaggtataccagtgaacagtgcccccacataaagtgaaattcaccttcacctttcttttactattactacatgctatttagttatcaggggaaactgaatttgtcacagatcatttcaagaatggcactgtgtatgtggattggagattaaatgtataaacatcatggtcttgtctggctgcaaagtgtagtatcttttctcgctcttaaacaatttctcattttttgtagagatggggtcttgctatgctgcccaggctggtctcaaactcctggtctcaagccatcctcccacctcagcctcccaaagtgctgggattacaggtgtgagccactgcacctagcctttattcgttctttttgtaataaaaggctatgttttagaaggtgcttgttgaaaaagtatgttataggaagaagatactgtggctgagactgctagcatcccccaataccccttctccttgcttcctcagtagcagaatcccaggcagttgcccagctcagaggctatgttgcctccctgcatttgcggggaggtgtgccgccacgactgaagctggcaggggagaccaatgtggaagtgcggtgtgggcttctgaaaagttgtctcgaaagtgaaaaggcagccgggcgcagcgactcatacctgtaatcccagcattttgggaggccaaggcgggcagatcactgaaggttgggagttcaagaccagcctggccaacatggtgaatccctgtttctactaaaaaaaaaaaaattagctggacatggtggtgggtgcctgtaatcccagctacttgggaggctgaggcaggagaattgcttgaaccagggaggtgggggttgcagtgagctgagattgcaccactgcactccagcctgggccacagagtgatactccgtctcagaaaaaaaagtgaaaaggcaagggcctttttgtcctatctcacttcgccttactgccagtagtagcttggtatttaaatagtgtaacaggtgcagtgtggtttatattacgctgtctcatgtacagtaagtgatgagatgggagaagtttagacaactgctctaggctgcgtctctacaaattactcatttcacgttgggcaggtctttcgttgtcagcaaatggaaagtcaaattaaatgtatttgtcattatctttcagcattggtgtttgaaatattagtgatgtcttgattcattgtttattcaaaatagaatttttagctgccatgggtttaaaaaaggtaagaattttgctcagaagtgtgcaccttccgaaactgaggatcatccttttgaggtgaatgtgcagaattattagcatttatacttctcatgaactttaacatttctgagttttagctgttttgaaataattccagacttaatagaaaagttgcagaaatagtgcaaagtgttccatagcactctcacctagattctgcaagtgttaccatttgactcctctatcattctctccctctccatttctatctatctatctatctatctatctatccatccatccatttacctacctacatatatatatatatatatctgcctcataaagaggaagagaaaatatatttatatggatatatgtgtgtacgtgtgcgtgtgtgtgtgtctgaagacagagagaaatatatgtcgtgcccagcccctatttttttttctgaaccatttgagagttagacgcagacatgatgcccttttgtccctaagtacttcagggtgtatttcctcaaaacgagcacagtatcatgattgaaatcaggatatcaacactgatacagttctgttatctaatatgcaaacttcaagtctcaccaattttcccactactgctctttacctttagcaaaatcaagaacaacatttagagtgattcaaggtttcatccaggctcacaagcctttcatctagtgtgtcctcaatctttgctgcctctcatggcctttgtatttttgaaaagtgcaggcactgatttttttttaaacattttttttcaaaagtttaaaatgcgataaaaatgtgtgacacaaaatctaccatcttaatcatttttaaatgtgtacagttcagtagtgttagatgtattcacgccattgtgcaatagatctctagaaccttttcatcttataaaactgaaactctgcacccaataaacaacaattcctaatttcccccaccgcctgcccctgacgtcccccgttctgctttctgtttctgtgaatctcttgtagtgaccttgtgtaagtggaatcatacggtgtttttctttctatatctggcctgcttcgcttagcaaaaagtccttaaggttgacctctggtgtagctctgacggatttccttccttttaatttttttttttttttttttttttttagacggagtctcgctctgtcccccaggctggagtgcagtggcgcgatctcggctcactgcaagctccgcctcccaggttcacgccattctcctgcctcagcctcccgagtagctgggactacaggcgcccgccaccttgcccggctaattttttaaaaaaattttttagtggaaacggggtttcactgtgttagccaggatggtctcgatctcctgacctcgtgatccgcccgccttggcctcccaaagtgctgggattacaggcgtgagccaccgcacctggcgatttccttcctttttaaggctaatattcaattgtctgtaaattccacatttggctcatgcattccatctgtcgatggacactttggttgctttacctgtttgctattgtgaatgatgctgcaatgggcatacgtgtgcacgtatctcttccagagtcaggtcacttattttttagaatatccctaatttttttagaatatccttagtttttagaaaataaggtcacttattttttagaattttttagaatatttagaacttgggtccatctgttgcttcttcctaattagctttaggttctgtgtgtttgtcagggatgctcgagtagtagtgatgtgcctgtcacagaccagactgctgatggtgaggttcacttttttttttttttttttttgggagacagtctcgctctgtcacccaggctggagtgcagtggcgcgatctctgctcactacaaccaccacctcccaggttcaagcgattctcctgcctcagcctcccgagtagctgggactacaggcatgcaccaccaagcccagctaatttttgtatttttagtagtgatggggtttcaccatgttggacaggctggtctcgaactcctgacctcaagtgatccgcccgcctcggcctcccagagtgctgggattacaggcgtgagccactgcacctggcttgagggtaactttatcacttgcttaaagatggtgcccgccagttttctctactatatggtcactattttgtccctttgtgataagtaaggattctgtggggagatattttgagtctctgcaaatatctgtttttattttttatttttgagatggagtctcgctttgtcatccaggctggagtgcagtggtgtgatctcggctcactgcaacctctgccttccgggttcaagtgattctcctgcctcagccttccgagtagctgggattacaggcacccatgaccacgcccagctaatttttgtgtttttagtggagatggagtttcaccatgttggccaggctggtcttaaactcctggcctcaagtgatccacccgccttggcctctcaaagtgctgagattacaggcgtgagccaccacgcccagctgcaaatatcttgtttgttatcaagcttccacccactcggtgattcttgtgtgaaacaattattcctgcagtgattacccagggatgacctacagattccgtcgttccttctgtacttatttgttgatattctactctaaggaaaagctttcccatctcctacatgcattcattcattcattgtatccacagttgagtggattcatgtgttcctatgtttctctgggttttagtctattactatcattattcattttgttgttcacattgtacaggattttgggtgcagtggctcatgcctataatccagcactttgggagactgaggcaggggggactgcttgaggctgggaatttgaaaccaacctgggcaacatcgtgagaccccatccctacaaaaaaacaaaaacaaaaacaacagattgtaccagatttggccagtggggaaccctttagaataggctcgtgtgtttcttgatatatccacatcatcttcccattaacttctatttcaacatcagggttttctgtgcctcatgtctctatttatttcggagatagggtcttgctctgtcacccaggctggagtgcagtggtgcgatcttggctcagtgcaacctccgcctccccggttcaaggaattctggtgcctcagcctcctgagtagctgggattataggcgtctgccaacatgcccagctaatttttgtagtttttgtagagatggagtttctccatattggccaggctggtcttgaactcctgggcttaagcgatcctcccagttcttcggcctctcaaagtgctgggattacaagggtgagccacgacacccagccaacttcctgtctttcaacagtgatcaattgtgggtatacatgacatacgaaataacaaagattaaatctatttcaagctgtcaagtggccgaacaccgaaggctgccacaggaaaattatttaaagatacatttgttaaaaatacgttgattgattaagaagttagaaattgaaacagaactatttctacttagggtgtgaaccccatatcacactctgaatccccaccagcagggaccgctcaagacccgttgcgtgccaagggtcttgacaaaggaatgtcccacccaatctagggctcctagcccctggactacccaacttggtcaaatgtatgcctcactgttccatcagcggtttcacttaatatagcagttctagactcagagacttttacacagagaaccccgagatcattctgaacttgaggtgcaggacagtgcattgtgcaaagtcacagagttgctgagaggtagagctgggatgggggctcgggccccccctagaatcacaggatccttacgtccagggctagtcagaagccagcgagtttgagtcgcagctgttggggaagtccctctggaatggtttcgacaggtaggatctggctgctgcatttgccgtccctctggcccaccgctgtccactgtacagagaaggcatctctttctaccttcaaatcagcatctggtttctgttcacaggagcaacgcgatgcacgacaacccccgcgccttcgtcagtggctctaactcctgtcacagccttgttccttctccctgtctcgctctttagccgtttctcgtagggatggtgtccaggtggctcggacaccctggtcgccgttctctgggggtagatgagtttatgaagaccaaattggatatgagcaaaagcactcttggtaaaattgtattcaatcaatccctagatgagtattttttttaactatccaggcccaccccagatgtctgaatagatttcttctgatcttggctactctgtgatttggccttcactccttgatttacccagcagagtcaatgacattccccaatacacacacacacacacacacacacacacacacacacacacacacagctttctgaggaggagtacacagaagggaacacgatccagtctcaacactggcgatgacagaccgtcccattctctcatatgaaccctacacattgatccagcccagcctggaggtttcctaacatctcgtcagcagctagcatcgctgtccaaaacctgcccgttttttttttctttcttcttttttttttttttttttggcttgatttggctctatttttagaatgttttccactgggagaaggaagaaatatgaggggaacagagcagggagaggtgccagctgtggcttgccagcctagggttgctccgtggcatgtgtttacactgcagtcatgggccggccttgcctggcccctgcgggtcacccgggcatgcttcccatacccagcagaacgtgatctgggttccagtttctgttctccctagtcctgggttaggaaactcagttgttttgacattgactcttcccctcacccgtgtgtgtgtgtgtgtgtgtgtgtgtgtgtgtgtgtgtgtgtgtgtgttgggggatgtcactgatctgctggggaaaccaaggggtgaagaccaaatcatagagcagcccagatcagagggaatctattcagacatctggggtgggcttgcacagttacaaaaagtgctcatccagggattggttgacctaatactttatagtttttccaaaagtgcttttgctcatatccagtttggtcttcgtaaggacctcttgaggtagatggggctgctgttctcattctacagatgattttactgtgaatggctgtctgtccacctcagagccctgcaggatttatggaagctgcttccagcttcttatgtgagccagtactcgctcctacttaggattatatattgaggttggacatggtggcttatgcctgtaatcccatcactttgaaaggcaggagatttgcttgaggccaggagtttgagaccagcctgggcagcataatgagaccccctgtctctacaaaaacaaaagatagaaattagttgagtgtggtggcatgcgcccataatcccagatactcgggaggctgaagtgggaggacagtttgagcccagaaactctaggctgcactagagtttgtgtgattgcaccactgcactgcagtctgggcaacagagccagaccctgtctcaaaaaaacaaaacaaaacaaaacaaaaaagtattgtgtatccattagttgaatcgctgcaaaggtaaacattcattcattcattaagcaagcatagattgaacaccttctccatgtcggacactgtggtaggatctggtgattcaaagatgaacagctgtccctgtttctaagttgcctgtagtccagtgattactctcaggtttctgtctcaggtgtccgtgtggagagactgccaaacaggctttatgtgagcaacaaggctgttgatttcacctgggtgcaggcgggctgagtccaaaaaaggagtcagcaaagggtggtgggattatcattggttcttataggttttgggataggcggtggagttaagagcaatgttttgggggcagtgggtggatctcagaaagtacattctcaagggtggggagaattacaaagaaacttcttaagggtgggggagattgtaaagaaccttcttaagggtgggggagattacaaagtacattgatcagttaggttggggcagaaacaaatcacaatggtggaatatcatcagttaagtcgattttcacttctgtgaatcttcagttgcttcaggccatctggatgtatatgtgcaggtcactggggatatgatggcttagcttgggctcagaggcctgacagtttctattaatatttgtatttcattgagaacaatgggaaccattggtgtctgccatttgggaagtggaagagatgcttagacagataagggagcagaggtctagacgaggtgtagagagggtcagaaaccaggttggggttcctaactcccaagccacgtccccagccacctaccgcagtcactgtcttgccctcccattcctattggataaaagctttggagataagacaagcctggttcatcacggttgagtctctaaacctagatatgcagaggttccctggaattgcttcttgagtccctgattaattcagctcttgacatcacaagatgaactcactctttggtgaattgcacagacttttgaaaactatgtttccgctgcgctaaagtctaggagcgggctccttagcctgaaggatgcctgtttcaatgggacgtgacagctgctttcaaacatttaagggcgagcacctgttgttggagggggatgcaggcttaacccatgtgcagcaacagaaagagacaagggggcatttccaggaagatcaactcagcttagtgtaagcaatgtctttctagccagtagcgccatctgataatggagcaaacagcttggagccaaagagccagaggtctaagctgaggatcccaggactcttcaacaggggtttgtggattcagtgggaagctggcccaagagctttcaagggccttggagtgaccacctgatttgtccctttgcacagtttgcctggtgctgcacttagagcttcactctgtgaagggcatagaacaccaacactcttctcatggcaaggatgggcttttgctcctgtttcttttcttttttctttttttttttttgagactgagtcttgctctatcacccaggctggaatgcagtggcgcaatctcggctcactgcaacctccgcctcccaggttcgagctattctcctgccttggcctcccgagtagctgggattacaggcacctcttaccatacctggctaatttttgtatttttatagagatggggtttcaccacattggtcagtctggtcttgaactcctgagctaaagtgatctgcctgcctcagcctcccaaagtgctgggattacaggcgtgagccactgcgctcgcctcctgttcctttttcatccacgctttggaagaagatggtgtcagggtcatagaagacccttagagaggagacatggggtggggtggtttaggcattagtagtggccatgtttcccctaccctgaatggggctttgcccagggctgttccatcgggtttatctgggcctcacagacgtctagagttttcttcatcttgttgtgtctgggtctgcacaatactgaggaattgtctggcaagaaacaaagctactcatgttctaggacatagttccatggctaagcatgaaaacaagcaagatccaagtgttcaagggcccctgcaaccctgacatgcctcctaggtggctggccatgtctgcatggggtcactgcggcccaggactcagactttcctctagaagttggttttggcagtgtacccagggagactgagtcaccaagcaaactggtaagagaatgcagataaacgtggttcacttccaggaggatcacaactgccagcagagagtattcggggggctccccgcagaattctcttgggggagaaggtaggtgggagttaggggccattgtgtgtggcgaggcagagaagggagaattcgggctactgtcctggctgctctggcagagccaaggtggtgtgatacgtgagtttctcagtccattttccattcacttattctcatggcagatggtgatctcctttggggaggtgaggcccgtcactacttaatgtggcaaggttgcgggttccaacatcctgctctttttctactctacccctccccttgttttcaagactttgagaggaattttccagaatcaagctttctggctctccttcctcttttgctttcataaggacaaacactattcgggggagagggcgggagagatattgagagccaaggcacatgagacagcacgggcagcagggtgctgcctcgtgagcttgccttttttttttttttcttttttgagatggagtctcgctctgtctcctaggctggagtgcactggtgcaatcacaactcactgcagcctccacctcccggttcaagcgattcttccacctcagcctcccaagtagctgggaccacaggcgcctgctaccacacccggctaattttttgtattattttttgtagagatggtggattagtcagggttctgtagagggacagaactaataggatagatgtatatataaggggagtttattaaggagcattgactcccacgatcacaaggtgaggtccacaataggccgtctgcaagctgaggagcaaggaagccagtccaggtcccaaaacctcaaaagtgggaagttaatagtgcagccttcagtctgtggtcaaaggtccaagagtcccaaagctgaagaatttggagtctgatgtttgagggcaggaagcattcagcacaggagaaagatgtaggcgcagagactaagccagtctagtctttccacggtcttctgcctgcttttgttcgggccctgctggcagctgattagatggtgtccacccagacggagggtgggtctgcctctcccagtccactcactcaaatgttaatctcctttggcaacaccctcacagacacacccaggatttttcaatccaatcatcttgacactcagtattcaccatcacagatggagtcttgctatgttgcccaggctggtctcaaattcctgtccttaagcaatcctccccccgtcacgctcccaaagtgctgggattacaggcctgagccactgtacctggcttgttttaatcttttatactgcatttttactgtacttattattattattattattatttttgagacagagtcttgctctgtcccccaggctggagtgcaatggcgtgatctcggctcactgcagcctctgcctcccaggttcaagcgattgtcctgcctcagcctcccaagtagctaggattataggtccccgccaccatgcccagctaatttttgtacttttagtagttttaccatgttggtcaggctggtctcgaactcctgaactcagatgatccacccacctcggcttctcaaagttctaggattacaggtgtgagccacagcacctggccttacagtacattttctatgtttagatatacaaatacctaccattgtgttacagttgcctacagtattctgtagagtcacatgctgtacaggtttgtaccctaggagcaacaggctataccatgtaacctagatgtgtagtaggctctgccatctaggtttgtgtaagttcactctgtgatgtttgcacaatgacggaattgcttagtgatgcatttctcagaacatatccccatcattagccaacacatgactgtatttcttttcttcttcttttgcttgaccaataaattaggacatcttaaaacttttgagaaatacacaaaaagctcaagccatcctccacatcttttattttttttttaaggaagataaaacatattcattattccttaagtggaagtgaatcctcataaaggtcttcctctctgtcgtcttcatgttgagtagactgggaaggaggaagagggggctggtcttgctgtctcaggggtggcagaggcaggagaaagtaggtgtacctgtgtgattcaaatgtgttgttcaaggtcaactgtatatggttggctctcacgatctaatattttacataggaatcttatatctctgtctgtcataaataaaatgaacttaaaatttccttttcttttactttttgttttaccaatcaaggttatgctagcctcagaaatgactagagttgcttttattcttttctattttctggaacaatttacttagataaatcatctgaggtcaggagttcaagaccagactggccaacatggtgaaatgctgtctctactaaagatacaaaaaaaattagccaagcatggtggcacaagcctgtaataccagttactcaggaggctgaggcaggagaatcgcttgaacctgagaggcggaggtggcagtaagccgagatggtaccactgcactccaaccagggtgatagcatgagactccgtctcaaaaaaaaaaaaaaaagaaaaagaaaagaaaagaaaaggaaatgcccacaggagatggagtgacagggtcggggcagagagaaatggaaacttactggagggtttgccgggacttaagttgagcaatttgagtcacttcacccagagccaggctatggctgctgtgtattctcctcacatccacttaatgagacactaagtccactagattggagaaaaatatatgatatttgtagaaaaataataattttttttgagacagagtctcgctctgtcactcaggctggagtgcagtggcacaatcttggctcactgcaacctccacctcctgggttcaagtgattcttgtgcctcagcctcccgagtagctgggattacaggtgtgtaccaccacacccagctaatttttgtatttttagtaaagacgaggttttgccatgttggccaggctggtctcgaactcctgacctcaagtgatctgcccgccttggcctcccaaagtactgggattacaggcgtgagccaccacacctggcctctccatgtcttttcatgacttgatagctcatttctctttagaacggcatcatattccattgtttggatgttccatagtttatccatttacctaccaaaggacatcttggttgtttccatattttaacaattaccaataaagctggtataaacatctatgtgcatgttatgaattggtttttcgaacccccaacatgacattgtgtggatagtctcagtctctgttctcaatcatgtgtgagttacaaataatttattgaaataagagccccctccccgtgtctttggctggtgatgatggaagggtttgtttcagtgttttgtttggtgtctcacttctctccctcatacatgggatttttctcaagagcaaatagtgacacttggtgtctaatgagcaacttctgattgctcccagactaccatgcttgtcacctcactctctctggggcagcgggtaggtcctagcttggtttgaacgttttaacctggctatggctggcacaggatcacggaaatgcggttgcttgtgtttgttgttacagcagcatttggaagcactggtaggagttagatgacattggctggcacagaagtgtgggaacaaaggtgatcctggagaaaaaccactccactgtcctctcaaggctggaccgagctcagtgaattcagctatgtgagcacctcaccaggcacttgcttttttttttttctttttttgtgacagggtctcactctgtcacccaggctggagtgcaatggtgcaatcacagctcactgcaacctctgcctcctgggctcaggtgatcctcccacctcagtctccaaaataactgggaccacaggtgcgagccaccatgcccagctatttttaaatttttttttttttttttttttttttgcagagatggggtttcatgttgcccaggctggtctcttaactcctgagctcaagcaatccgtccgcctgagccacccaaagtgctgggattacaggtgcgaaccactgcactggccaggatcattttcaataattgccctgctaatgtctcattctactcacggaaggtccttctctgacctttccttcccaaacagctcaattgttctaggtgagtctgaatcacagcctgatcagcggctaaattaggattccactcagcaccctggggttagggtggccctataatgagtctcctagggagctagctatctgcgtccgtgtcaagcagaagggaaaaacaaaaacaaaccaacaaaaccaacaaaaaccccagcaaactctgctcctaattggctttcttctttgatctctgacctggttccttgactactctaatctcaactccctttacttcttcccataaagcaagtggggttgactaggtagtcttgaagtttccttctatctttcatagtttctaggaccacgacctaggagaaatcatcaatctgcgctagccttggtgttattgtagctgtaaaagaatcatcgtattagaggaacatttacgttattgggagcgttttctgaagggccgcctttgtgatacccaggttagtaggagggaagttggccaagccctagttggacatttggggtgaagatggggcattagcagagctagggaatgagttaggaggatgtccaaactagtaaactcggaaccagtaaattaccagaatacagttgcagttgggttgtttataagtgattttgtagtgaagcagtttcatctctcatgagggctctaccctaacttacctggggctgtaaaggctgccaggagttctagctggccattaaaaaaacaaaaacaggtgtgcattcgtccttgctcccacgcactcccagtttgcacttagatgtaaggagcggggggggggggggggcggggggtggtggtggggcggggattgagttaacttccttttgcctgctgcagagcaagtgcaggaggcgaatgggggaagaacatagtcttccctctagactcggaacgcgttattgacagacaggaaaagtgcccggtctgcgaaagttcagctggacctccgggacatcaactccctgtgccctaagagctgaccgctgtcagatgcgttatctaggtcaagagatgaatgatgtgccgctgctggggcagacgccgtctctctgctctccctgtgagctgaaaccagcagtgtttgcaagcttgtagggagtgtggaagaaggccccctggtccgcttgcctcgcctgtacgtgtgcaaaatcggtgggcaagcagcgggcgcgcaggtgcaccgtcattccccaggaaccgcgggcgctctttgcaggggtgcagccgctctccccgcgcgcagcctacagccctccccgacccccgcgaaccccagggcgggaactcgtcccggtggcgcgggcgctcgctgcctgctgtttccctcttcgggtcagcccactcttatttcaggagtggagtgggactctcccctgggcgtttagggtgtcgcctctggcatgtgctcccactgcagaaaacaagtccaaatgcaacgcatcgggtttctgaacagccgccagagcgcggaaaccagaccgtcagcaaagctgtcgcgggaacaggggctctgagagggcggcgcggggggcggggtgccggagtgggggtcgaggcgggagggggagtgggggtcgaggcgtgggggagggtggcggggcacaggccaggtggccgatgttgcgcgttccggggcccctcggcaggcggcgggtcgggaggagtggaggcccgggtggggcgggcgcgcggggcgggagcagccccggtcgccgcctgggcgcgggcgccctccctgtggagcatgcgggacgtgagcgacgtgtggcagcctctgcgcagacttttccgccgcggtgtaggtttcagcgagcgccgccttccctccaatcacagcccagcctcagcgctaagtgtgcacctctctgcaaggcggcgcagcgctcccgtactgaggcttcgtttgcaaaagttacatccgtcccggcgcgggcggcggttccccaccaaaagcaacccagatcttccccgcacgcctctgacctgactgcacgactgtcacaagtcgcgagctggtgcaaactgcgagggccgggaaaggagacggggcacgcatgcaccaaaaagtggggaggcagagctgcagggtgtgcaggataacggagtgaattttaggagtctgcctaataaggggccgcccccaatagttttccctcgacttaggtaatgaattgcagatcgaaatgggtctagttttattcattcttctactcggggcgataaaggtttattgaatggtgtacatggtgagtgtgaaaaccagatgccagctgcccccagccccagtccacttcagtccagctccccggggctttcccgccccctcctcgtacccagcaccgcgggcctctcaaggttcccagtctttgggctaggggaggggagcaaggctcagttcaagtccaggtttctaagggattcagcaaagtggacaaggacgaggtgaggtgggaggatcagggaagcctcctccccgcgggtcgcccgggtcgtggcgggggatgggctcacgggtattatcagggagcagcctggcccatgtccttacctggactgcgcctgccccacagcgcgtgttaggaatgcagagtattggggctccatggccctaaaggagctgcattggtaggatgcactttaagcagcttcccaagggattcggctgcggggtccacggtctacactgggcaggactgcgtctctgctctcctcccggccagcacagttgaggtgaggggccggaattagtcggggaagctgtgccagacgtcccgaggggacaacgggacgaggggataacagcagccaggacccttcagcagggctgggcgcgctccaggcccggggcagggcggcgggagctggtgcaccgccgtcgccggcccgcagggggagctcgcaggctgcttcccggctcgcccaccctcctccccacgtggaagggggctgggacccaaggaatgcggcccgccccgaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatgtgagtgcagctgcgcggagccgggttgcagggcgggctgcgccgggccgggccattgtgtggggcggctttgtgccgacgcccctctgcggggggcgcgcccgtgcgggtcgcgccggcggggcggggcggaggcgcgggctgcgcgtccttggccgggcggcgggggcgctgtggcccttgtcccggtggctgccccgccggcccggaaacggcgagtgcgcccggccgggctgcgtaccccgagacggagggacgcgcgcgcctgggcaggccagggaggggatccacatcctccgcgatccctgtcctcgacacccgtctcgggcggccgtcgccggagcgcagcccagggacccggccgctcgcgcctccgccccttttcaccgtccggatctcctctctctgcatgtttccatctcctctcccgccttgctatgcattcctatcccctcgcttcacttaataacctatttctctgtcctgttttctctttcgatatatatgtctctgtttttctctgtttctacctccttcctctcccactgtttctttctgcttttatctctttctctctccttctctctcttccgtgcatctccagtgccatgggggcgcccgtgctgggggcgccaggagagccacctggagccacgcctgtgtccccggctttggggagggtcggtgggttggtgagtgcacggttggcgctgctccacgcgccccgggcgcacgcaccccccggtgctcggaattggctggcagtaccctgccccgccccgccggtcgccgcccccgccaccagcgatcgcttgggagagggttacctcgagctccacctcagctgcggagcgccgccgcggaaaagggcgggtgggcagcgcagaggggcgacgctgcctctccaggtaatgcgccccggctcccatgggctggacagggagccgcctggtgcggttttgcccaggtcaggtcgtagcctgagtagtgaccgtgggatccaggtgcaaactctcgaggtggcttcgggtcatccgaaggcgcctgagcgcaggcggctggcaggcagggttgcccggctactacgtttcttaggacggcccccgcgggacttggcagctctcctggagccctgctcggtctgaatcaccggcctcgtccagacctgcccctctccccacacccacccccatggtgtgccctgggtggggacgtcagcagatccaccctggtggacttcagggttctggggtagccctcaggagaggtcttgttccccctctttgtgaggtagcccaggactgggggatgtgggtgtgttgcccagcccagtcagatgcgcttgaactggggtggcccatggttctcttgtctttgtgtaaaacctgtaagtggagtggaatgcagctcttaaatccccagggaggtttggccaaggccaaatgcagaaacaacttttgcataaagcaagtattatctctatagcactttgtaaactgcattggaggctagtcccacatatgtaaatacatgtgattgtatacgaatgcccacgggtctgagaggagtgtcccgtgacttccagggctctgagatctgttggcatcagctcagttgtgatcttgagaactccagcgtgcaccaaggcgtcctccctccaggcttggatcctgatccattagaccccatcaacctgcacgtctcacacgcagtgagagatttgcctaagaatccctgtcagaatcattcagagctggagggtgggaatttggctaaagccaatggattaattcttttgtcccgcctactgctggtatcctcctgtgtggctttgaggtatagtctcagacacattccttcttgtaaaaagatccgcagcctgggtatcgcacatccttatttcaagtggtggtgtctttctcagtttatatagtcacatttaactcttactggaatggagggaagaaggtgtttctatttggtatctttcctgacaccctccctcgattctctaatggcatttgggacattgggtgggtttttctttcttccttttttttttttttttttttttgacatggcgtttcactctgtcaccgaggctggagtgcagtggtgcgatctcggctcactgcaacttctgcctccgggtttcaagcgattctcgtgcctcagtctcccgagaagctgggattacaggcgcacgccgccatgcccagctaattttcatatttttagtaaagacggggtttcaccatgttggccaggctggtcttgaactcctgacctcaagtgatccgcccacctcagcctcccaaagtgctgggattataggcatgagccaccacgcccagctgggtgggttttctttctcctaaacttgttgccacctttataagtggccttctcattggaggtctgcagcagagttccctgaggtttattatttatttatttatttatttatttattcatttttgaggtggagtctcacactgtcacccaggctggagggcagtggtgcgaccatagctcactgtaaccaccaactcttgggctcaagtgatgctcccgcctcagcctgtccagtagccgggactataagtgtgcaccaccacacccggctaattaaaaaaaatttttttttttttttaattgatcattcttgggtgtttctcgcagagggggatttggcagggtcataggacaatagtggagggaaggtcagcagataaacaagtgaacaaaggtctctggttttcctaggcagagtgtttgtgtccctgggtacttgagattagggagtggtgatgactctcaacgagcatgctgccttcaagcatctgttcaacaaagcacatcttgcaccgcccttaatccatccaaccctgagtggacacagcacatgtttcagagagcacagggttgggggtaaggtcatagatcaacaggatcccaaggcataagaatttttcttagtacagaacaaaatgaaaagtctcccatgtctacttctttctacacagacacagcaaccatccgatttctcaatctttccccgcccctttcccccctttctattccacaaaaccgccattgtcgtcatggcccgttctcaatgagctgttgggtacacctcccagacggggtggtggccgggcagaggggctcctcacttcccagtaggggcggccgggcagaggcgcccctcacctcccggacggggcggctggccgggcaggggctgacccccccacctccctcccggacggggtggctgccgggcggagacgctcctcacatcccagatggggcggcggggcagagacgctccccacatctcagacgatgggcggccgggcagagatgctcctcactgcctagatgggatggcggccaggaagaggcgctcctcactttccagactgggcagccaggcagagggggtcctcacatcccagacgatgggcggccgggcagagacgctcctcacttcccagacggggtggcggccgggcagagacgctcctcactttccagactgggcagccaggcagaggggctcctcacatcccagacgatgggcggccaggcagagacactcctcactttccagactgggcagccaggcagaggggctcctcacatcccagacgatgggtggccaggcagagacgctcctcacttcccagatggggtggcggccgggcagaggctgcaatctcggcactttgggaggccaaggcaggcggctgggaggtggaagttgtagcgagccgagatcacgccactgcaccccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcctcctgcaatcgcaggcactcggcaggctgaggcaggagaatcaggcagggaggttgcagtgagccgagatggcagcagtacagtccagctttggctcggcatcagagggagaccgtggggagagggagagggagagggagctggagcttaaaaaaattttttcatagagatggggtcttgctatgttgctcaggctgatctcgaactcctggcctcaagtgatcctcccaccttggcctcccaaagtgctgaggttacaggcatgtgctaccattcccagcctccctgaggtttattgctgaagagggtgtctaggaccctgctttttatagacaaagaacagtaaaacaacaaaacaaaaattactatatcaataagctgcattatattcttgccttggaggcaccttaacgggatgccctgttgctacatcaacatgatggtaaatgcttcttacaaaacctgtagcttccttcgcatgcatcctgtaactcctgctgacttactgaatttgtgagtcagcataatggtcaagaagtacctttttgactggcaaggtctagctttcctttctgttcatcgtcactaaaattcaagagcctgtgtgttctgagggatcctgggtaccgggctgagtcctaagatggtgcttgggacttggcattacatcagaagttgccatgatcagtggagcaaaggagggggtattagtactggtcaggccagtgcaggtttgtaagcaacaggtaaaagacagccttttaaagcaccaaactttgttttttgagacagggtctcactgtcacccaggctggagtgcaatggtgcaatcacgtctcattgaagccttgaactcctgggctcaagcaatcctgtctcagcctcctgagtagctgggactaggggcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttttttttgcctcttaaaaacagtggaatgagacaaactgccagcttgtctttgctcaggatttagacaccatgggaaattgagtctgaagaaaggttgatgtggcactcaaatacggatagaaagactttcatctcagtagcgagttacgccggctgctggtgttctagcttaaggaagctgggtgggtgatgtcctagagaaatccctgccttatccctgggtagcccctacagtttatttactggggatgcattctgtgttagggtttgagtcagtgggggatacaggctgtgcgggctgctgcctgtctgtctgtgcattgcacaccatcagagaggttagtaacttaatctatccgggagagcaggagtaggaacccgggggtgccagcctctcactgtccaggtgggggattcaccatccatctggctgctgctttccataactggctccttgtgtcactgtatcccacggctgagtgttcaccagccagccttcagttttcttttggcttcctgtgtatgtttgcctgcagggaacgggccccagtaggcagtctccgttgtacactaatggtactgcgggcttgtagacagccagggcttagcccaaaggcactactcagccacattgaccctgtatcccccaagtagcctctgtctcacgggtacccagtgcatgtacctggtgcatgtgcccagtgagcgagcgtgtcatgaacgtagcaaccttgcagaattgaagttccgtgcctgggacttggtgactttctgggaggacttacccacgtggccatggttgtaaccatgacaacactttgagctcgagtcccccagattcaattcgggtgtttagtctgttacccagggtctttacacagttgttccttcccctgtaacccggtgacatctgtgttcccccaggcatgtttcagttgacctctaaagtccacatctaaacacatttaagtttcacaactttcaaaaactttaggtgtgtgaaaaagaagttaaaatattgaacatttacataaaatgaaatgagacacaaatactctttggaaaatcttgtgttaaactcaataattttttttttgtttttttgagacagagttttgctctgtttcccaggctggagtgcattggtacaatctcggctcactgcaacctctgcctcccaggttcaagcgattctcctacctcagcagatgggattacaggtgcctgctaccacgcctggctaatttttgtatttttagtatagacggggttttgccatgttgaccaggctggtttcgaactcctgacctcaggtggtctgccctcctctgctgcccaaagtgctgggagaccatgcccagccaatacttaccttttctttttttttttttttttgagacggtgtctcactctgtcacccagactggagtgcagtggcgtgaccttggctcactgcaagctgcgcctcccaggttcacgccattctcctggcttagcctcctgagtagctgggactacaggcgcctgccatcacgcctggctaatgttttgtatttttaatagagatggggtttcgctgtggtctcgatctcctgaccttgtgatccgcccgcctcggcctcccaaagtgctgggattacaggcgtgagccaccgtgcccggcctaatacttatcttttctaatcactgtgccttgccagggagggtgatgaggcgggtggggggtgtctcttttttggtggtaaaaaggcccattgagaagagaagaagaaactgagggtcacagaattagaaacatgagatgtgctgtgagtttttaaaaggggctgaggttggagaataagacaaaaagatttagtaaggatttgtgattaccccatctgtccaagacagtggtgggtgtctgaagggagggacaggtgcaaacacctcaggcgcccctctctttgtttttttttgtttttttttgtttttttgttttttttttttttgagacgaagtttcgctctgtcacccaggctggagtgcagtggcgctatctcggctcactgcaagctccgcctcccgggttcacgccattctcctgcctcagcctcccgagtagctgggactacaggcgcccgccaacatggccggctaattttttgtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccgtgttagccaggatagtcttgatctcctgacctcatgatccacccgcctcggcctcccagagggctgggattacaggcgtgagccaccgtgcccggtgcgcccctctcttgttctgcagtcaaatgctctacccctgagctatatccccagttatagcgcccctctctttgaatcttactatgcgacagagcagtgcatagggagaatggctctgctttgccaagaagggactggcagtttatttgggtttgaaatccagtctgaccttttgccctgtgtatttactctgctgtctttattgttgttattgttattttccctccctaaatgtctactgccagaggacatttgttcctatgattagtgggtagacataatcccctgttggataaatcaatcagcctctgcttccttggcgtggttccgacagaaatattctgcgtatgtgcacagctgagagtatgtgtgtgcgtctgtctctgcatatctgggtgctcttaggagcagcggtgcagtggggacacctggtaagaccaggagggacccttggcctaggggaagggtcagtggatgggtattgtttccaaggagttgctgctactttcctgatatggcagctacagctgccagaatgaccctgggcacggtggggtgtgcctcactggctttcggggaggccaccatctctccgtgtgcccctggggacacaagaaagcccctgggtgcttggtgctttgtgcttgtttgttccactcatgtgctcaggatgcccggctcaccctgggcagtgaaaagcatctgttttcgaggaactgtttgttctaggtcactggacatcaagagcatggcagcccagggcttttagcgtctcctcatctgctgatagcctgtctgtctccttactctgcctgctgagaaggccactaatggtctccaaatagcatggaggggacaaaggcccggcatgccatgcctgcttccctgcccccacctccaggcctagcggcagatcctggacattgacttcagtttggagccctgctgggggctccggcttacagaggggcttctttcctgagctgcggcccgtctgaggggtggtggctcccgcagcataagcctgctcagctcggacatcagggcctctgtccagtctgacatctgcctggttctgtgtgcggctttcagaggttttcctgcaggccatgtgggctgtgtctgggaatgatgaggacagccaggctaaccacgtggcagtgagtgctgggccgtgccgcccaggcgggagctggcgggtatcatctggccctggagcttgcatgtcggcaggatgcgggagttgcctgagactcccagggccaggcgacagccggggagatactgggccctcggctcccagaacagggggcttctggctgctttctgaaaaacccagcaaaaccccccttcctgctgttttgtcttactgagatgccaagaccgtcatgtagcagcggaagccaggagggagctggcaggcaagagcatctccaggtttcctggagacagtggtggagccggcccctggctgaggcttcgtgaccggcccttccctcggcagggccccagcattcatccgagcctggcaccagaagagggggtcagacagggcgtgagaggctcgggtggaggatttacctgtccactggggtaattttagcattctgcctccctgacctactttcatttgataaactcttttcttctaattattttttaatttatttgtttgtagaggcagggccttgctatgttgcccaggctggtctcaaactcatggtctcaagtgatcctcttgcctcggcctcccaaagggctgggatcacaggcatgaaccaccgcgcctggctgtaaactcctacttttaaaaattgcctttttaaagattttttttagaaactctgcccatacctctgtgtggaggtttggatattgatggtgggcctctctgtctcttgacccctgggccccagcccctgcccctctgtccccatgttgtattggaatccaccctcttgactcttagccccactctccctcgggagaggaatcctttcctcccacccgcaggagcatttccactttcactgtggtgtcagtcactggttccctgctaggtttagcgccctgggtatcagctcaggaatttggggttgggactgtctttgccaagtagaacctaaaggcaggactgagggacagggtgtggctggggggctgtggccactagggttgcctggtcccactgtggtacaatgccaggggcttcaggatggggagatgaaatgaaaatttcgatgaatgctgggtgtggtagctatgcctgtaatcccagcactctgggaggattgtttgagaccaggacttcgagaccagcctgggcaacacagcgagaccccatctctacaaagataaaaaattagccagggatggtggtgtacacacttgtagtcccagctattggggaggctaaggccggaggattgtttaagtctagaggtttgaggctgcagtaatcatggtggccaccgtgctcccgcctgggcaacagagtgagaccctgtctcaaaaacatttttggtgaaattcttcagtgttattgttgggtgtggcctctgctcctcttctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtgagtggcagtgagtgcgcattcctgcctgagctccgcctccagtctgatcagtggtggcattagattcccatgggagtgaaccctattgtgaactgggcatgtgatggatctaggttgtgtgctccttatgataatctaatgcctgatgatctgaggtggaacagtttcatcccaaagccgtacacccacaacccctccctgtccgtggcaaaattgtcttccacgaaagtggtccctggtgccaaaaaggatggggactgctgttgtggatgacacatttaagaatctctgcttggtcttcccaactagatggggaacatcttgtggataggcactgggtattttttttttttcaattaattttattttagattcgggtacatgtgcatgtttgttacctgagtatattgcatattgattggggattgggcttctagtgaacctgttacccagatagtgaacattgtacccaactggttattttttaacccttgctcatctcccaccctcccctcttttgaaaggatggtttttatgtttaccatccccgctgtgcccagctcagtgcccaggaaccatgggacacatgtctccggccctggccctggcggctgcaccagcagaagggttgacctagatctggcggtgggcatgaggccccactcgctttctgataccattggtggaaatgtgttgtccctatttttgctagacttggggcctccccccacccatcctcacagtctcagtctctggtttaggatattgtgggactgagattgtagacttggctggaggggacagtgtcgcagagcatgcggcaggggcattgcagctggactggggaagccgggcagcctgtgccctgctgtcctcaggagttgagggtagcgtaggactgggcgccggcattgcttccacaccatctcattcaagtcggtgtggttggcctggtggctcttcctttggtcgatcctatggtcccggtgtgagctggccccttcctcctgctcgatcatccagactgttctctttcccgtccacagtgttcaacgtcggggagtatcgccgggaggctgtgaagcagtacagctcctacaacttcttccgccccgacaatgaggaagccatgaaagtccggaagtaaggctgggccgcgggcgtagggctgggctgtgggaataaggctgggccgcgggcataaggctgggctgcaggagtaaggctgggccgcgggcgtagggctgggctgtgggaataaggctgggctgcggggctgcgggtgtaaggctgggctgcgggcttgggcttgctttgttctgagccaggctctgtaggaggcagagaaagccggcctgcgggtgggtcctgctggtggcttcagggctgtgcagtgtgggaacaaggttgctgctctcatctgtcccctgagggtctcgctgagctgaccctcactgggacagagccgcagaagcaccctcactgagaattagcaagtcctgttcatcgggagtgtctgtttatgtttggaaaggatttcttgttaagtgcgagttgattgtgaaaccctagtgcaagggtgttcagccccggctgtatgctggagtctcctgggggatgctaaaatccctgatgccaggccccaccccagaccagttagtgcaactctgtgggtggctctgggcagccatttcttagcagctccccaggagtggttcccgcgtgcagcccggtttgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggagttgcttgggctgccccagcggatgcaccggcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggaggatgtggggtggactcagggacccaccccctctgtggccagtcccacacctccagggcgggcaggactcgagttacccacaggaccactggcccttccttgtacactgtcccattgcacattactgttttgcttgtttgcttttggggtatttcccccacgctaccacccctgagtgctgttggtagttgcgggaggcctgcctcctaagcactccctggagaggactgtgggcaggcacaagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaatgactttaaggtgagctgagcgtcttgtgttgtgctagagggctcgggagagaggaaaaggcttcaggaagcggcctgagtcctgcttggtccttcccctcctgctgcccatgttccttagtcctgctcggtccctcccctcctgctgcccacgttttgtggccttaaatttgggcctttgtgtggtagggctcttgggggccatggggcgttccagaggctgcagtgaggaggtgggctttcctgtgtttgggagttggtgggtggcgtgcttccgccttgtccgggtgatgacatcgcagtgatggcaaggttgatccttcgtggtgtttgttttctaacatccccacctcacttccaccaggcgtttttcatcgagtcggtgtgcgacgaccctacagttgtggcctccaatatcatggtaagacagccgggagccccgtgcttctgcggcagcgtagaccacaagggcatttgcagtctgaggaagtgggggaccgggtccggctcggaagcgcagctgagcccttaggatgagcagcccccagctggctgttgattgggaggtcagacctacagagcggtttttaacccagaggcctgtcctgtgagggactagctccatccagggcagtgggcaggcttggatgggacgtaggaaataattcagggagataggattagtttctgttggtggcaggagcctgacagctagtggtgatggagctgctggggcagagggccgctcactgcccctaatgggacaggtggcagcaagtggatcacttgctacagctccaggaggtaagaatgcttgggcattggcaaaagtccatagggctcagcagcctcctgagtttgggaggtaagactctcctcctgctgatgcatctcgtgaacctgccacaaaccctcctgtctgtgctgtgcaggggagcttgcccagataaattgagggcacttggcatcataacttgatgaatttctccagtgttaccacttgatagcaatatatataaacaggaatggttactatggagacttactacaagctgccaccctgtgttggagataatttcctcttcagcttaaacatatcagaatatgacaattctataaagaaaagcagttctgaaaacttaacactgggacgctgtggtgctggcatctttgcacctttagaggggatgctaagcatgtgttagccccggtatcttccccaaggtggtggaagtatttctagatatctttaggaaatgaattcctgtttcaggaagggctatttgaattgtgaaaagtcagtttagatttgtccagtgggagcaggaggctcagagtatgagggtttgccacctttctttggctgggcactcgttgttccccttggtagacagcagggtgcagctgtgaagtcatttttcccagtgagtggtcaccaatgtgcttagcaaggagtttagcatttgtctggttgtccactagcagataatcatttgccccaacccaccatgttcagaaatctctttctgatgaaatctcaaagcagcttggtagagccaggcatttgtgaacttagattttttttttaaattgtggtaaaatatacataatgtaaaatttaccatcttaatcatttttattatttatttatttatttatttatttatttatttattgaaacggactctccttctgttgcccaggctggaatgcagtgacacggtcttggctcactgcaacctctgcctcccgggttcaagcgattctcctgcctcagcctcccgaatagctgggattacaggtgtgcgccaccacgcccagctaattttttttgtatttttagaggagacgggggtttcactgtgttggccaggctggtctcaaactcctgacctcaagtgatctgcttgccttggcctcccaaagtgctgggattacaggcgtgagccactgcatccggccattttagctattttttaagtgtgcagtacagcagcaaattatattcccattgttgggcaaccgccacactctatccgcaggactttctcatcttccccggctgaaactgtgccaggacacaggcacagctcccgactgactcgatctttgaagagtggctgcctctcagtgacggcagtggttgatgagaaaaagagcccaggcattcagaaatgctgagtttccctaaaatccacctggtttctggggcctgtgccactgtgggtgttggtagacctgtgttgttgcctaggagagcgagccctgcaaaggagccggcacagccctagttggagaagcagttaaccacggactggtcacactggggctgcctcaggcagtggggggtggaggagaaaccacacaaggccagaggcatctctgggaactcctgagcataccttagaaccagcagcctcctcccggcacggggagcattgcggatcctcacgtggagctcggttgagttcagcgccaggctgtctggcggtgactcgggcacgggacagatcctgacttgctggagcattcagaggtgttcattatggaatccctgtgggtttcctgtctctgtccttccggcttcagttctccatctccccagggaatcctccccatgtaacatcaggctgtgactcagcccccagcatctttctccctttctcttacacgctgggccggataatctttatactgagccttctgtgcgctccccttttgaaagccccaaatcctgcttaatctcagcagaaagccttccagcgtgatttatcagccacccctttgtggtgttgcaggaagttaaaatctccagcccggattacaaagactgcaactcggcagaagccatggacgacttcatgaagaggatcagttgctatgaagccagctaccagcccctcgaccccgacaaatgcgacaggtgattcccgtggctggccgtctctgcaagacccacatgagggttcttactgaattcttgatgttcccacaaaggatttgctcctggatacctttaaaaaaatttttttaagacagttttttttgtagagatgaggtctcgctatgttgcccgggctggtcttgagctcctggcctcaggtgatccacatacagccgctggatacctttatcaactctctttgaaaatatcttttaaaaacaatccttgatgacaaatcatattcagtgggaatattttgaacactgtgtagaagtacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctagagtgcagtggcatgatcatagctcactgcaggttcaaacttctgggctcaagtaatcctaccgcctcagcctcatgagtaactgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtcttacgcatatgctctgccccttagaaggattcagtctgtgccctggaggggcctacggtcccgccttgctgttctctggggatcacatcttcggagacgggccaggtgcatcctgctgtgggtggtggcctgagctgtggttctcggtggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaaggtgcggggtgtgctgccgcatgggccgttctggctgtagggcggttgcagggtctatagggtgggtggggagctgtgtgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcggctgtggctgtcccagtggcctggggcccccacggtgtaaccaggtagtgcacagccctacgtgggctgcctgctccagccctggctcttggaggagctgcgggcatctggaatcagtggtccccctccaccacctctcagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcggtgagtcctgggaggcgggcaggcagcctcaccctcgggcatggggcggcttcccaagaggccctagacacccctgtggtttgttcccctgagtgaccactgggtccccgcagggcgtctgtgaggagctgacctacgaggagatcagggacacctaccctgaggagtatgcgctgcgggagcaggacaagtactattaccgctaccccaccggggaggtgagcgcaggctggggcgggctgacggtccccagcacacatgaccactgctgtgcagggctgggccacccctccagggagttcacttccgtgtgggttctgggggctcctacaccctccaccttggaactgagtccccccaaactgaaccttctaacagcctggggtgaagtgcattttcccataagcagaagtgagatgtgtttccctagggacatagaactatatgggagaggaggaaggtggtgtgtgaaggtccactgggcagggtggtgggcaggctggcaggaggggtggctctatatcccctgggcagcgtctgtgcttccccgtgcacggtgcccgggtggctgtggctgaggacgctgttgcctcctctgccgatgggatcctcctgggcctggtgtgtcctccctgcccgtgccctgctgagcagtgtcgtgcctcaggcccctgcaggcccactgtcctctggcctcagactaagccttacacaccggggccctggttagcacagcagagagcccacaggagcaggagcttttctggtctttttctaaagtcacagccctcctgcttctttttacatttttaaattgatagaaaatacacataacctaaaattgaccactttcatcacgttaaagttatgatttagtgcatgttagtgtactcacagtgctgtgcagccatcaccacaaattccaggcctttccctcactgcacaaagaaacccagacctgttaggagccgctcccgcctgcccggcccagccccggcaccggcccgtctgcttcctgcatctggatctgcctattctgggcattccatgtcagtggagtcagatgccacacgtgccttttgcgcccagttctttcacacagcattgagttttccaggttcccccgtgtgggagcggagtggggagggcttcactctttttgtggctgagcaatagtccacgttaaaccctgctccttctcaaccactgctgatgatggatgattgattttgcgtggctctctggccggtctgatgcagtctgtggccagcggcagagcccctcccgagtgccctgagctcacgtgggcccggccctctgtgctcagtcctaccaggacctggtccagcgcttggagccagtgatcatggagctggagcggcaggagaatgtgctggtcatctgccaccaggccgtcctgcgctgcctgcttgcctacttcctggataagagtgcaggtacctcgggcaggtcgtggccccgggatggagggaggaggggactggcactcggcggggggtcagccgcagacctgccgtggcctgccctgtgttggctgctgtgccatggggtgttaggagaagggcacaggtgtcggctcccggctgcttcaggtcctctctgtccagcgcttccttgaagcccttgggaaatgctgtggagcccaggttgatgccggggacttcattgcttcataaacagctccctgagacccgcccctggctccacacatcccagggtcttggcttggggtgggggctgcacttctcttcagtgccctctaaggaacaaacagcccggaaaactctgacaatcccattgaaatgttaagtcttagcatgtccagtccagtgcagctgaatccctagacagacctaaattgtttgggagtgactttttcccaactctaagtcaccgtgagggcgagtcttttggtttggtttgatggcactctttgggctaaagtcttcttctggggccagctgctgcccgggacagcttgtggctggggacagatgcccctgcccgacagggcttccgagggtccttgttggggggaccgtaaaggtctttccatgcctcccccaccctcatgtctcatttcttttttttgagacaaagttttgctcttcttgcgcaggctgcagtgcaatgcatgcactcactgcaacctccacctcccaggttcaagcgattctcctgcctcagcctcctgagtagctgggattatacgcatgtgctaccacaccctggctaattttgtatttttagtagagatggggttttgccatgttggtcaggctggtcttgaactcctgacctcaggtgatccacctgcctcggcctcccaaagtgctgggattacaggcgtgagccaccacgcctggccgtgtctcatttctaactgtgggtgtacaatttcaatttcagaggagatgccctacctgaaatgccctcttcacaccgtcctgaaactgacgcctgtcgcttatggtgagtagcaacccctgccaagccctgtccccctgaaggtggccacagtagcttcttgtggccgtgggctgtaagcggtgctgtccctttaacagcagcttcctctgcccccatcccacgccctccaggctgccgtgtggaatccatctacctgaacgtggagtccgtctgcacacaccgggagaggtcagaggtgagtggaggccccaagcctcatcctggccatcatcacacgatagccctagtgggtgatgggcgctcaggaggccccggggccgcttgcctgcaggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcggtggcgcagtcacggctcactgcagcctcaacctcctgggttcaagtgatcctcccgcctcagcctcccgcgtagctgagactacaggtgcgcaccaccatgcccagctaattttaatttattcatttttttagataatggggtctcactgtgttgcccaggctggtcttgaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacaggatcagcaggtcagcgccgccatgtgcttgtgattaggctcagaaccaccaagaacacggtgttgagagacgggaggcgtggagagcagaggcctggggggtggcgggtggggaggcgcttcaggagacctcgaggcctggccgtgcagctgctgtctaccttggggggaggcctgacatttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagaccgagcgtgactttctgtcatggcgttcccgaaacaggtgactgtctagtcccaggaagcttggccttcggattttggcatgaagggatgaggtgtccgccccagtcgctggcagttgcctggctggtgggctgacctgagagaggctggggtcccttggccgccttggtccctgtcaccccctccacttcggaatgtgggtcaccggatgctgtcctgcctttagccatatgacaacagccctggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgcctttggtctccaggcttgttttgcagcctccgtgccccatcctaagccagggtgccctttgtgtagtagagatggctcttcagatcctgcctcgggtcagcggaagggagtcagcacagttgccttcccctccccagcctgtgagcctcaggcccagcctctccctcctagatgcccctcctcagctctcaagagaggctggaagcaaagctcttttctccgacctcacgctctgctgtgatcatcattctttccctccttgctttgcaagcaccgtgtttgtctgtgtggggaatcctttggtaccatccgaggaagggggcatgggagggaattgcccccattcttgctgcctggcagtcaccgcacactcagcagcccatggtccctggcccgtggtcccggccactcccctcggtcagtctttttgcctctctaaaatccaggagcagagaaacttttttggggctaattttcctccccttctttgtaactgtcgcctttctctcttttgtctttgtcttgcttaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaagtcagtgcactcccctttccttcctgcctgggggacgcatgccgggcgtgatgccacagatctgggattgcgtgcgtgtgtgtttgcaagaatacgtgcgtgggtgcgtgtgggtgcgcgtgcgtatgttgtaggtgtctgtgcacgtgtgttgtgggggcatgtgcacacactcacgtgttgagggagaacataggaagcaccctccgaagttaagatcctgggggctttccttgctggtgacaaccgtgactgcgttcgcctcctttctgaggatggggtctttacagggcagaagcaggcagtgcagaaggaagagtgagatgtccaagacccgttcacgttcgtgaatggttatttctaaaacaaagaaagtggctactttctcacataaataacatggttatcccagcaggtagtaaaaaacctaacaaacaaggccaggcgcggtggctcacgcctgtaatcccagcgctttgggaggccgaggtgggcggatcacctgaggacaagagttccagaccagcctggccaacatggcgaaaccctgtctttactaaaaatacagaaattagccaggtgtggaggcgggcgcctgtaatcccagcttctcaggaggctgaggcaggagaattgcttgaacccaggaggcggaggttgcagtgagccgagatggtgccactgcactccagcctgggtgacagagggagactccgtctcaaaaaaaaaaagcaaaaaaccccaacccgatttcacttatttcattaattttgaaggttacaggcctggaagattttggttgtcagacattaagatttgttttcagaaaactgtttgttttcagaaaactggtcttttcctttacagcctggaacccttgcaaatatgtgagatgtaggaatttctgtgcttaaattcaggtaccacccaagggtctgccctacctccaccctccaggcctgcccccacaaatcagcccagtgcagcttccggtcaggtttgttgatgagccggatgctggtgctggctctgagcatccttttcagcctgccacctcttcccgccttttccgagacttccttagacctcatgatgtctggaatgtgacctgggagatgctgcagcctccacaggtcacttaacctctccaggcctcagttttttcatccaggcaatgggggaataatggcagtgcagaagtcagatcagatgaggggattcatgccctgcatcaggcccagtgtcgggcatgtggtggggacgcgtagacacggtgaggtggctgtgattagcggaagcctggaggcctggctttggtggtagctccacactaacatgagtgcagcaatttaattgcccaggttccttcccctcccaggccctcagtctccttagctttgcacatgataggagcaggactgggagagctctcatacatattcccttgcaggtctcagatctgagggtttttatgaaaagccagcagaactgaaatggtgtccctgtggcatccgttctgatggaaatgtgcagttgtatttggaagttcagaggccgctgctttgatgcttggggggaccaggctggggaagggggttgatatcctgagctgcacagacctccgtcgtggaggacgcagtggcaggggctgcatcctcctgtccgcttcagagctgcccctggcgttgggaggacagtccttcagggtggccaggttcttagggacgtctgaagctgctggctgggccggcgtggggtttttcagggcttcgtccctgcagattgcgccctgcctcctgactgacttctctctctgcttctcctccgcagcctttgctagggcaagcctgtctgtaagtatctctccgatcatcgctgctgcttgcactgctttcttcctgcttgctcatttggcctcctgcctgttaaaatattgaggatgagagcagttttgtgatgtgaggtcttccgtgggggaaggaggagatgggcgtaggagtagggaggagagattcctgaatgtttttggaaaagcgtgcaggcggtcatggtggctgcactactgttgggtgtgttccgacaccgccgcacgaccgctggcttctcccctaccctctcagggctgcaggtcgtggtgtgtaatggccgtggtttagggctcggcataaatccacatttccttatcagaatcagatcttggtggcgagctgcatctgtgccaggtgccattagccttaaagccccctcctgccccaggagtgtcctttgttttggaaggaaaacttactcagagcctaatctgtaaaccaaacctatggggaatagtgggagtgtggtggggcctgagctctgagcctctccctccccatgaggaccccccacaccccaaaagagctccgagtggagacccttggggatccgtttgtcctgggttggagcctgctcagcgtcatagtcacgcccggggctgggtgcagcctccatctctaacccatgtggtcacttctgctcctcccagagctctctgcagagtttcaggttcagccttagctctggcagccactgggtagctggggctgtgttcccactgctctgggatcccttccccaccaggagcagaggccttcctgccacagaactttaatgacagccacatgaagtgtcatccccttgcccccccaaaaacacacccgcccctttatttcctgtttgctccttaagttaccttaactactttatgcagaaactggaaaggtgtgatgaggaatgcagcctgagatgctgaaaagaatgactggctttggaaatgggagaggtttggcatggcgctcagattttggtggcaaaggggtgaagggccagaggatgtaccagtgtcctccatgtccacgttccttaagaccaccctgggaggtcggcagggcagtcagtcccccgtttaatggttgaggggctgagtgaccggcccgtgcttccagcaggtgagccgcagagccggggcctgaaaggccccttgcttcagaaagccggccgcctcctctctgcggcttctgggagtgggctgggtgcccgttccctgctgctgtcctgaggcccctgccctgtgacccgcaaggcatgggcagctgttggaccctcgtgtacccccacagccacccccttgcagctgcttcccacagccaggctttgcttacctaaggtgggcctgcccttaacttccagcttcttggggcgcaccctccatcctcagggccagtgtctgtgatgcgcggggccagcgtgcagtgcttcaggatctgggcttctccttgtgtgaaactttttggacttggagcctgaaggttttacatctgtgcatgtcctgatcctttagaccagcagtccccgacctttttggtaccagggacccgtttcgtggaagagaattttccccaccatggcagggtaggggatggtttggggataaaactgttctgcctcagatcgtctggcattagattctctgaagggaacgcacagcctagatccctcgtgtgtgctcctccgagtcaggtggtaatgttggcccacccaccacccacctcctgctgtgtggcccgcctctcagtgggctatggactgggtactggtccacagcccaggggttagggacccctgcgttagacacgtggcctcatgttgccaggaaagaaatctttctactgggaggagccattcggggatagtcccccacccgctaaagctgatcttacctatctccaagatgaacataatagtgcgtttgctagaatccctcctgttcagcaaaaatacatccgatggacccatcacacctgactcaggttggaatttcactctggagtcccattgtcccgtccatcctgggtgcgtgaccccacatctaggattgtagccacatctgattctaggagtccacctgggctctgtgaccagaatttatgatgaaagtcagaccaagccaggcctgcatcttggttctactcctcctggcctctatccttggcactctgggcaagttaaagcaattctaggacctcagcttcctcatctgtaatatggagataataacttcataaagttgtcataatgagactatagatacagcacttagcacaatatctggcccctaggaagtgcgtgggggatgacggctgctgttgttatcagggaggaacttggtgccctgggcctgtggagacttctgggcttgctggcattgggtcagcctttggataccctcctgtaacctgagggatttcttctctggggcagcaggaacacccagacttggggaggggaaatccctggggtctcaaggccatggcctgaagtctttttttttttttgagatggaattctgctcttgttgcccaggctggagtgcagtggcgcgatcttggctcactgcaacctccttctcccgggttcaagcgattctcctgcctcaacctcccgagtagctgggattacaggcgcccgccaccatgcccggctaatgtttgtatttttagtagagatggggtttcaccatgttggccaggctcgtctcaaactcctgacctcaggtgatccacccgccttggcctcccaaagtgctgggattacagatgtgagccaccacgcccagcctagagtcttcacccctgtgatcttggtttcccagtaagatggggacgaacaactgtccggacctggtgctctggggtgccttcctgggggctgtgccggctgcttgggatcgagagatcacctggcatttgtgatgcaaccttcatttttaaaatttcaaatgcacactagaaaatcctactaaagattttctttttttttttccttttccaacctgtttcttcctctcccccactctgcttgaaagacgaactgtctgtcacattttctcaaagttttctccttactaactgtggaaggtaaatgcctgggtgcatgtccctctgtcccgcaccgcgtcacggcatctgggtctgtgtgcagactggccatcgtgcaatgcggggctcatctgtctccatgccgaggttgttaagtgcaacaccattgtcgtgaggtcctttctagtctgtctctcaccccccacgtgtcctgagctggggcccctgggtgaaggacgtggacatcacccggtcttgcaggctctccactgttattgttgcatcgccatcacctgtgggtgccggaagctgtgggctggtggtgttgaggacaggttggagccagcagatgcggagggaaatgtcagccctgctctgtgatcccacagcccggctggggctctccctagatatgaggacccagggctctctgaagagaattgccccctcccagtgggcacccatcacttccatcatccttcggcgggcacccatcaacccccgcaggcagccgtcatcccctggcaggcacctatcacctcctggtgggcactcatcacctcccggtgggcacccatcacctcctggcgggcacccatcacctctcggcgggcacccatcacctcccggtgggcacccatcacctgggttcctgagtctggcccacgcctgggcgatagctctgatgctgcccagccccgtgactttcctccctgtggatggctccagccttggacccccagttctgtgtggggtgggcatgggccacggtggccctgtgtgcctgggctctctcccaccctctttagagcagtccaggtggagacactcaggactggagagaatagttttaaacattgtgtgttttcttgttttttgaggcgtaggtgaagcaggtcacggaaggaggcccgctgtgcagtggctgcagtcagttgtgttcctcgctgattttggagcatgtttttttgcggggggtgggtggcgggggggtttggtactggccagtgccttaggggtggaactccctgcgagggccactgtgatcagaagtggggcagggctttaacaacacccctctgcctggctccccacctgggcctccccaccacgtccagccattccatgtatcacctgtgttctgcctgtcaagctctgttcccagaatctggatgcaggagctgggagtgtggctctgttttgagctgagtcgagaggaggggccctgtgtgtccttggaggccccgggctcatcctctgcctggctgtggtttgtgggatttctatggggtcgtgagcatgaggctcctgtagttactggtgcccagcgccgcgcagctcacggtcctccaggagccacacggcccccaccaggcgggctccaggcctggtgcccagccccttctctgagactctggggttatcttgcgtcatgttctgaggcccacctgggctctctcccgcctgtgaggttggcagcacctttcttggatcatgttctttgtctgggatggagggagggaagaattctccgttgcatggctcgcgtcttctgctttagaattcagccagctacaaatcctaactccctccccacctctcttttctcctgaaaacagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaa

SEQ ID NO: 15 - DNA, 33802 bp, homo sapiens
tccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtgagtcgcgcgcccgcgggccctcccgccaggaacaaaggcgcagactcctgcccgccttacgccggccagggcctcccccgccgccccgctgcgctgtgcgcccggggcgggccgcgcgcctctccgagcctggctcggtgcgggtcccgagcgcagcgccccgccgggccgctggccgcagtggggatgggcttcggatctagcgggccggagggcgccgcgtgcgtagttggcgccggcactgagcacatggcctccttccgggggcgccgcgccgtccacgcggccctgctggggctggggacacagggcccgggagcggcacgtcgcacacgacctcggcagcagcagcccagcctcggcccctcccggtgcgggggagggggcccgagcgcggcgcccattggctgagcgggccgagcccccggcccggccccggccccggcgcgcggaggagtcaggagccgcccccgctctccgtctgctcccctagcccggacgcccctgtaggtgggcggcctggtgcgaggtgtcccaccggcctcccctactcctcccgccagtcccccgcggtgacgaggccgaggccgaggggagggcacttttctccaggcccgggctcgaacgcgggggttgagatgaacctccggtctcggaggctctcctttgcgaggagtgcaggccccaaagctttggcccagtctcgcggagatgtgttccgcggaggcaggtttaccctcggggccaggcggggagcgcaaccggaggggcgggggatctgggggccaggaaagagccccaggctgaagtctagcgggaagcgcgcacgccacggggttggggaatgagggatggggactctggggaccaacaactccctagataggatttctttttttctgtgtaagtgggcttgtcctgcagggcatctttgtagcgtccgcagagcgatttcttttcaacaaattgtttgtggagcccctcctgtgtgtagggcattgtttctttccacctcctttcctccccctagtctacaatattttcaagtcccctttttcttttgaaacggtccctctttatctattatactttgatttttccatctcgtcagctgggagggcacctggatggcccttgttttcttagctgggacgcgggggtagcactgaattttgaactgcccttcctactggctgtggaggtgtcccgctgagactgagcggggtggcgctgggccgcaccctcggcaggaaaaggccttccgccccacacctgttgaatccataaatccagacgacttggttcacccttcctgggccctcgcttgaggtgagaccccggggaagttcccggggaaggctcccaggatcttaggtgagccgtaagggtgggatataactaaacaaaagttcagtgagaagctcttctagctagtggcaaggaagtccaaatatctcagggctcttgcaggccacttaacttctgggcctcagtttttccatctgaaagagatcacttttgtcacttcctctagggaaggaactatctattcagcatactatgccagacatgggtatttatttgttgagtggataagggaatactacgtggagacagaaaagtggaggagaaaatcagcaggttcttagccaaactactttaagcgtcacggaccttatagccctgctggttactcactagcctggagctcagagaagggaaataagtttgccaaagtcacacagctagtaagtggttgaactggatttgaacccaggcccatcagatttaatttcatttctgtctccactgtctctcttcaccacaacatttcttgaattttgggcagaagggagagagtttgcctatcttcaaaggtggccccttgtgccagctggttctaaatagtgtagcaggtgggtgctcttcatggagtgttctccaagttttccactgtctacctcgtcagtaattaatgttggaacacctctttcacagtggtgtatctgtatttttatttttttatttttatttatttattttttgagacggagtttcgcttttgttgcccaggctggagtgcaatggcgcgatctcaactccctgcaacctctgcctcccgggttcaagcgtttcttctgcctcagcctcccgagtagctggaattacaggcatgtgccaccacacccagctaatgttttttttttttttttttttttttttgtagttttagtagagacggggtttctccatgttggtcaggctggtctcgaactcccgacctcagatgatctgcccgcctcggcctcccaaagtgctgggattacaggcctgggattacaggcgtgagccaccacgcccggctgtatttttaaattcatgcacatgcagtttgatactaacagatgatatgccttcataaaatagaaatttcaaaagacagatagatacaagacagcagttatagtcattttcccctccaaatcttgtgtagatcattccatatacattctggaataaagcccttccctttggagactgctgatttgacctgcaagcacagcctttttgtgcatgatgttagaggcctggggaggtcatatcgcttgcctttcacacaagatctgaaaaccaggtgtgtctggctccaaagccttggttctgctatgttcctctttgtctcctaggaaatgggaactgacttaactaacttccccgtgttccattgtgctcctctgtaactcacagtaatgagcttagctgaataggaagtaggggacagatggaatcaccttgcctacaagccaggggttcgcccacgatctctcctgggcagcacgcaagggtgagccctgccccagatgtctcaccccacccttcgtgaagaacttgtaactagccttgcctatgcccatcactcatcacttttctggccagtctctaccttccagaaaaggaaaaatcagaaatctgcaggctttctcagcccctttgtggtgcagacagcatagttttttgttttttgtctttttttgagacgaggtctcactctgtcacccaggcaagtatcttggcttactgcaacctctacctcccaggctcaagcgattctgtcacctcagcctcttgagtagctggaaccacagacatgcgtcaccgtgcccagctaaatttttgtatttttggtagagacagggtttcgccatgttgcccaggctggtctcgaactcttgagctcaggtgatccgcccacttcagcctcccaaagtgttgggattacaggcgtgagctaccgcacccggccaaacatagatgtttgcatatgtggttttgaatcccagcttagcttagttgcccagttttcatcattacagtgtctaggaattcagaaaagaatgtacgtctctgtccccatagatgctccataaatatttcttgcttccttggactcccatgatgccttacctgggctgtgggtgacttgtacctgggccttggcctttatccaaaagctggcattctggcagtatgagcttttggggagtcaggatgctggcccatgggtattaagtcaggtaaatcattaaagctcccactaacccattcttcctagtaggggcttgttgggaagtgagtaggcatggcacatgggtgagagtgccaggccagggagggtcagctcatgtgagtgccctgcgctgctttgggcttctttgctttgcttttttgccttaggcttcctgcctacctttctgaatttgggtcacccttgggatagtttgaaagggacattcatgtccattaactccaagggtcctcacaactgccctgtgatacaagttacagtgacctcatggtccaataaaaaatgactttgccaagatcacacactgagcctcccaccccaagacatgctgccagcctttccaggatgacattagagggtggaaggaacccagagcaggaggggccttccagccatggcccagccctccatttgacaaatggggaaattgagtccagagaagggaagagatttgtccgagataaggctatcacaaaagatttgaggcgttctatggagctgtgttttgttttgatttttgagacggagtttcgctcttgttgcccaggctggagtgccatgacacaatctcagctcaccacaaccttcgcctcccaggttctagtggttctcctgcctcagcctcccgagtagctgggattacaggcatgtgccaccatgcccggctaatttttttgtatttttttttagtagagatggggtttcttcatgttggtcaagctggtctcgaactccagacctcaggtgatccgcccacctcggcctcccaaagtgctgggattacaggtgtgagccaccgcgcctggcctagctgtgttttttttttaaagatgctttcttctccacatgcctgtctgtgccatcctccacccaccccaaatgagcaggaatccccagacacaggacttgccatgccataggagcctgaaagttggattagacgtaacttgacaactgaaactctactgtgaatggaaacaaaacactagatgttcccactaaactctgaccttgaagaagtggctttccttggagccttggtttccttctcagtaaatagagacttggctacccccagtggatgtggtgagactggccccgtgccctaaattagagaagtggctattttaagtggaaagaccctttgtaaggccagtctgggtgtacaaatgatgtaaacagccccaagatgatccttgtctagtaccgagccatccagggattcgaccctatttgccccggagctgggccagcctcaaatcccccgtaatcagcttgtgacttcaaggagctcagctttgcccagtgcctcctggtcacggggtgtcggcccagagctctgctcaagtaccaagggtacagccatccagctccctgcttccccaagactggcaaagctggggaggcctggaacaaagaggaaagtgtgcagtgttggcttggggcctgcaacctcaccccttcccccacctcactcctgggcataaaggtgataaagccgctcactcagtctgcagtctggtaaccgacgtccccatgatggcggaggctgggaggcctcctgaccagattcatgggctcagagaggctgtgtccaggcctgcaggcccagccctggctaccctaacaagcctccaattgttacctctctccacgggaggggtggactggagcctgaggctctgtcttccagccaccaggcctggcagtagctgatgcataaacattagggttttgcagtaactgagcagggctcccaggccttgaacctgggcagaaagaagacagcatctcctctctttgtgaccacactgacttgcctccctgaggcttctgcaccctggaatgggagagagctcttgccaggcctcagctgatggagcctttggctactgaggcctctgctggacaggaagtctgcctatgtctcctagcccagtttatctccccctgccctggcatttgggagtggggaggaaacggctccatcagaaacagctctaccattggaccttaggccagccacacttcttgttggagcttgtgtcctcagctgtactggggatgagagctagctgtctgggtcagcggcactgaggctccaggggagcatgtggtctgtgcagcaggcttggggagtgctgagcagcacagattgggtttcatagcacagtgggagcccagacaggccagctagccataagcacctctgctggaggaagaggtggactctcttgggctggagggcccagttcaaggaaagaaacaaacagctacactgggctccttgatcacccagctgtggcagttcttcttgaggacttcctgcccctaggtgggggctgccttcagctccctgctgcgtgtgataacttgggtgtggccctcacagctgtgcagaagctattcccagagggttctggccccaggtaaacagattctgctctgggctcgccttgcctccatcccacagccctgtgtgctgtctgtggcacagcctagagcagcactgcctcgtggccctggcccttatgcggctggagctgatcctgaagtccagtgtcccagcggtcatggctggcatcatcaccatctacaacctggtgatggaagtccttatccccaactcgctgatcgactgcatcagcctctacgggaatctcctccagccaagcgctaggctgagtgtgggcctgagtggcccggcagccagctatgtcatcagcactgtgggggacacagtgctgcctagaagcccgggctatttgtgggcttgatcctgatcctcattttcactgcatggtctcattctctccacaaagtagcctttgagcccaccagccacagaatgtgatataaagatcacccctgcttattccagaatgaacagcctgagacacatatcccttcagtagttggtcttgtgaatgcagtgtcctagtgcaaatgcccatcatctgttgaccccatccttgcccctgcctgccccatgctgtggatatctgggccccctcatcacccatcctggccccctgaccagtgaggatgccccctcccatctagggtactctgcgtctaaggatgaattccagtgtaattttctctcttctgtaggtttatttatggaagattggacctgttcatacatctgtggggcagccctccatctcccagctatataaagtctctaaccacagtgttgcattgtggggttaccatgtggtctgacacttccttgcatgaactaccctcactccagccctggacagtccagggcctagcaggcagtgtgtggggcctaccaggtcctggcatccaagctgtgtccaataaagttcttagatgtgactggaaaaaaaattggattaaaaaaaagcttcagaagttacagagccaactacagagaagcataataaatgaaagagtgtcttctagttttgacagtttggtgtttaccctaaagacttctctttgtgcatgtgtagatacatgcctataaatagaatatttgtgtagttggatcccactttctgcatagttctttgcaacccattctgttcaccaaaccaacccttagaggtaaatactggcagtgtttctctctgcacatacaaccaagtgccactatacaagttcactaactccctgttccttacacaatatgtacatcctattgctttttttcccccctgaacaatctaccctggtactcttcataacacatacatgttatgtgaaacacagatgtgtttcattctttccaatagctgcataatacttcattacaggcatgtcccaccatgattaagaaatagcagccccatcaccttcttcataccactcaccacctgatgtattacatgtatttattttctgccccagccttcaactaacctatcaagttccataggcagggatttggtatagttttatcgctgaatttccattgactagaagagtgttgggagcatgcattcaggcataatctttccttagcaatatcatttattcatagaagatcctctcttatggagaattaactgaagcttagaggaagagacttttttttgagacggagtttcactcttgttgcccaagctggagtgcaatggcgcgatctcggctcactgcaacctctgcctcccgggttcaagtgattctcctgcctcagcctcccgagtagttgggattacaggcgcgcgccccccacgcccagctaatttttcgtatttttagtagagacggggtttcaccatgttggtcaggctggtcttgaactcctgacctcaggtgatccgcccacctcagcctcccaaagtgctggaattacaggcgtgagccaccatgcccagccaggaaaggacttttttaaggtcacacaagtggaggagctgggacttaaatgtgtctgctgagagtgacagtgaactttgcatgtgcccaatcttaccaaattaatgttctcttagttgaattattgcccatctcaccaccaaatgtgtatcttctcaggggtgtcagtttccccagggtccagatcctggccccacacccacacatggccaaggagccatttacatttaacattccataataggatgcataccttttcggttatttagggaggatgtggttttgcctggaaggctttgagaatgctgggcagctagctcaggggacgtggggcttaaagcagaggccgatcaacttttttctaaagggccagatagagcgtaaatattgtcagctttgttggacatgtagttctcggcctgccactcagctttgctgttgcagtacaaaagcagctgtagacaaatgagtgtggctgtgttccaataaaactttattcatggtcactgaaatgtgaatttaatataattcttacatatcacaaaatattagtcattgtcttttttttctccccagctacttaaaaatgtaaaactcattcttagctgccatagtttgccaactttggcttatagcaaatgcagcaaagtggcccaaaggtttctgagcctgtgcccgggctgtctcagctcagagtgggcaaggctcagagagttgcttttatggaatttgacctacatagaaagcaccaggtagaaaccttgtttccttcagggaccagtacccggaaacaagggggaggacctaagcaggaaagccatagaatttggcatcagagacccccaattggaaacttccctgaagcctagagtcccctggttctgcgcttttccctctctctcatttctcatctgtgaaaagggagtaatcgctccccaaaagcttgttcatggtggttaatcagaatgtgtgagcagcctctggcagggtgcctcagctcgctgctgctgctgctgctaaatgcaccagccccctcctctcagttctactttgaagactggcgagtgccttctgcctcgagggcaaccaggggtgtctggaggttcagtcatgcaagggtcttgatatcattggaaggcttaaaggaagtggcttcaggagcacttaatgcttgaggtcaccctaaggtcaggttttggactgttagtccatcactcttcttttttaaaaggcttggcaggatggaaccggtcagagggtagaatgccaggctaggaaaccaaacaactctagtcccaaccctggcttttgtttgtatgctaggctgggcacctgccctctgacctcaggtgcctcctgtcaagtgccgatgttacagcagtctgcaatttcttgagcttctttctttcttattgcagccaaagctgtcttatttttttttcttttgagagtgtctcactctgtcgcccagactggaatgcagtcgtgcaatatctgctcactacaacctccgcctcccaggttaaagtgattctattctcctgcctcagcctcccaagtagctgggattataggcatgtgccaccacaccccactaatttttgtactttttttttttttttttgagacagagtcttgctctgtcgcccaggctggagtgcagtggcgcgatctcagctcactgcaagctctgcctcctgggttcaagccattctcctgcctcagcctcccgagtagctgggactacaggcatgcgccaccatgccgggctaattttttttttgtatttttagtagaaacggggtttcaccgtgttagccaggatggtctcgatctcctgacctcgtgatctgcccgccttgcctcccaaagtgctgggattacaggggtgagccaccgtgcccggctccaacttttctatttttagtagagacagggttttgctgtgttggccaagctggtctggaactcctggccttaaccaatccgcccgcctcggcctaccagagtgctgggattataggtgtaagccaccgcgcccagccttgaggttctttcttttaatgcccagaagttcatttaaatgagtaagaaacacaacaaaacaaattaaaagggagctgtcatggattcaggtaaacccctcccccactcctttgagccgtggactaagcagttggaaagccctgcgtcccctgcttccctgcacctggggaacccatgtgggatgctgtgggaagaggacaagatggagcaacatctggagtctgccagccctgggaccctcctcttgccaggaataccctgcctctgagtagcagtagccacgtgcccttcctgtgccaatatagattgagaacctgctgcaggccaaccctggggctggagcgcaatgctgacacactgacatgggtcaaaaggccacagtgtttggcaagttatacaatgtggccagggccatctggcatccgagcgttgggggagaggtcctgaatcttaacacctcatccatggcttcctgggagagggagggctcttgtgggtcgtgagacccccagcggtgggatagggagggtgaggggtggggacatgagaaatgcttctctgtgctggaccctgagcccagttgctggccaagctgggaggccatgactctcctaggagagtcaggatttgaactcagtctgcctgacttcagaggtccttccttgacagccctgtgggcttggagtggagggttttgtggggtgctgtatttacctctcagagctctgatgttccagcactcgtcaggggtttgataaatggctaaggatgaacactggtctggcacaacagatactcacagagccagctttgcccaaaagccaaattgaaaagtggcaggtttctttgtttggcaattagcatgtgctgttccctactctcgtcactctggctgcagacacggtatgacccaggttccattccttttttttatctcactctgttgccgaggctggagtgaagtggcatgatcttggctcactgcaacttctgcctcccaggctcaggtgatacagatgtgtgccaccatatccagctgtttttttttttttttttttttttttgtgtgtgtgtgtgtgtaattttagtagagacctggtttcaccatattgcccaggcaggtcttgaactcctgagctcaaatgatccgcccaccttggcctcccaaagttctgggatcaccgcgtcctgcccctggttctattcttaaggagttcccaaactgagtggcagatgggtaataagctagagactgcagaggacatagcaagagcaaaggcctggaagagaatggaatgttctagaaagtagtctcatccccagggagtgctgatgggctgctggggatcccagactctgggctgtacattgctccccaccagtaaaaaaggctcccacaagaaaatcacaagctctatggggctagtacccttctctaagtcatcaccaactgttcatcagcttgacaccagaataaataaatacacgttgagtgaatggacttcattgccatgttccagttctagccactggctggtgggggcagatggtgctgaggctgcccgatcgagggtagcttgctattcttcaccgatccagcaaacacttgtggagggaattctgccaggcttcatgatggatactgatagaaaacgtaacagcaaccctttaaggaaggaactttcatccccgttttctaggtgaggaaaccaaggcccagagcagggctgccttgtatccaactccaaggtgaaaggaggcagcttgctgcatttaaacgtgggtctgcttccaagcccagcaatgatcaagccggctatagtgggcgcagcagagtggcagcatgaatctgagattggtcgcagtgtcttgtgcctactgaggagcaggggccatgtccctccccctacacctagcactgagccacactgagcacgctgtttcttaatctgactggtccccatttcttctccttgcacatactgttctgtccacctggaatgtagccttgccactgctttcccacttggcagactctctgtgtgtccttcacagcccagctccaatgtcacctcctgggaactcatctttttttgtacccaggcaaaactggaaatctttccctccagggttctcacagtgcctcataccagccccctgttgaagcccagaccacactagcctctcatcttcatctgcctccccactgcccccaccccactgtactggaaactccttccttggtgtcaggactgggtccagtttcatccggggccccagctctacttagcatgagacctagagcatgggtcactggtattttagtcagtcctagtgcagcagctgcctgggtggatgtggatatgacccagggagtgggtaggcaggttttctaaagtcgagtttgacctcgacctgctgatgacaaggtccagcggaggggtatgtccttggcctccagcagcccccattgacagaggctacagtcgagcagctgctcagtggggccccagggatgacttcagaggctccagacccctggaacatcagatgcagacctcagtaaaacagggcctgtgataatagcacttacctcacatagccagtgtcattcactcatgctctaccaacataatttttgccagatccatggatcatttgtattattttccacttaatgtttttatttaaattgctttgttctaagtaatatgaaatcacagggcttgtaaaaattattttgaataggtgattccattcacaccattcagaattcaaaaaagtgccaaaggctataaaatgaaatctccctttcaccctgtccccagtcacccaggcccccccggggttagaatgttacctttcttgtacattcttgttttttgttttttgtttttttttttttttgagacagagtctgctctgtcgcccaggctggagtgcagtggcgccatctcggctcacttcatctcccagataaagtgattcttgtccctcagcctcccaagtagttgggactacaggcacgcaccaccatgcccagctaatttttgtatttttagtagagacagggttttgccatgttggccaggctggtctcgaactcctggcctcaagctgagattatagatgtgagccaccgtgcctagcctcttgtgcattcttttaaatagatgtgtatattctccccctacccccagccaatttttttttttaacccaaaaggtagcatacaatatacacactgctctgtttttggtttcgcttttgttttttgggacagagtctcactctgtcacccaggctggagtgccatggggtgatcacagctcactgcggcctcgaactcccaggttatgtattccattatatcactatgccacgttttcttaaatgatagattgatgtcactgcattgcttgttttttaatctattctaatgtgttccagaaaaatacagtatatactttgcatcccatgagcaaatgcaggtaataccgcaggcagaaagcccagcacgtggcgggcctagcagtcgctgtttagtgagccctcctggtgatgcttagtgccttgccacagcctctgaattagtgtccaccctatgaattaggcttgacctggtgtgtcgctggggtcccccagaaatttgtcagctgctcactacccactcggaacaacagctctgggcctgaaggctccccagagaattgagagaagggagattctgggggcagtgccaggacatacggggggtgggggctgtctttctagttgggcaatgcagaggatttagagggaatggagtccctgtggtatgagggaagccccagcatgtggaataaatgtccagaggcaggctaaggggtcaggtagacagactaatgggaaggaaggatgcagcgcacacacagagggggctctgagctgcacactcctcctgggccgaagccttcttcctctttcgcagcctctgatgtgagagccttggcttttgcagtcgttgccctgactgacgctttcagagaatgaaaagaccatactgggaatatgcctggtaacagctatgcccagggctatctgtgatgatcttgaagtaaaggctgcttctgggttctgtggaaaccaaggcccagagacccacagccaggccatggccagctccacccacttccagggcccagcttggtatagtgtgcgtagtgaatgccagtcgtttctttggcatgcctcccgcagccctgttctcccacaatcagttaaaggcctgcctaatgtcacatttcctgacttcctcatttttatagctgaaaagagcacttttcttcagcagggctgacaccctgctggcctctcagtcacctgtggctaagcagggctcttcacctgctggcctctgcccttcctgctgccttaggtcctcggcttccaatggacagaagcaaactgctctttttctctcccatccctttgcccattggaaacaccttagccccacactcttactcaccttgtgcacttttccaaagtgcattcccgcctagcatgtcgtctatgtccatataaccttgggaggcttatggtttggggattattgccgtgaggagcactgggtaaggagtccggagccctgagctctgctgcaggctcctgagtgatctggaacttgcctcaccctctcagggctcagtttcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcagaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccacagtctcacgccaccacctgaattagagtcatttatatgaacgcactgtactgtctgcctctccagccagttttctggccctgatcatgtcagagactcttctcttgctttggaatcagggtggcagaattctagaatctcaggtcccacagaatcctggggtcttgtataggccctcttgaccaaccccccacccaactcagtcatttaataatatgtttgatgatataataaactcaaagcaaagctcaatacaataatgctgcatttccgtggcattctggggctgcagagggttttcatgggcttgtctcacttgatgctcactgcagcactgtcaggaggcagcaggcaccactcccagcctgcaggtgtgggaaacggccagagagaggaaacccgcccaatatcacccagctaagtcagagacagagctggtatccaacacctgcctgccaggtggtccttgagcctgcactcatacccatccacaggcagcacacttcctttatttgtaggttgaaaccgcgtcctctccctgaaggccctgtggcagtcaaagcagaaatggcgtcttgccctagggagccacagggggtgaaggtctgtgctggcttcctcctccctgccgtgcatcctagatctgtcctcacttgtttacttgaatgtcaggatgggaagggacctagaccatctcctccagcccagcctacttgcattaaggaggagagaagaggaaaagggggtagggggtaggaggcagggacaggaaaggaaactgagcccttcctctgtaccaggcattttgcttgtgtttatgagattgggtggtgatttccattttgtagacccggaaactgaggcccaggcagatgaaatggccgacaggcccaaggtcacaaagctattgaatgctggagtcagaagccaagctctgttgtttccatggcctcaggttgtcttcctaaccagctgccttgcccgtttaaaaatctgtaccttcccagagaggaccaaatgagagtgggcagtcctcacgtcaggaccacatttcttgtccagacggatggggctagaaagtgagtgcagtgactcccaaagatcagggtcctgtttgggggaaccaggtagtgtctagagttagctgggcttcttccaaataggcagacagtggctatggggccacgcccgatgctgaggagcaagtcaccaggaaggcttggcctgctgagtcatgctcagctgcaggggaggtgacaggacttttccaagtttgctgggcatggagaccgtgggcccatgcttggaccagccccaagccctgcatttgctaagtgctcttgacagctcttgccaaagtgtgtgcttcagaactggctccctttgggaatccttacagatggaaagtctgtaagacaggctgggaggaaacagagggaggttgagctctccacttggttgcacattggggtttccagaacgcccccagattctgatttaattggtctgggatgctgtttgggcattcaattaaaagcttcccaaccaattcgaatgtgcagccaaggttgacagctactggatttaatgatgtcttgactgtgatctcatagtgagttaatgacagaactaggactctaaggccaggacagaggaggtgttttccagaaacagaacagggttggggtgagcagggggccttcaaagcaaaatgcccagaagacagaaagcctggcattcagtaaagcgtgagtagtttagtgtgtcactagagtgaacaggaggaggggaaaggttggggaggtcaacaaggtaaggtaggcaagagccagaccacaaagggccttgtgagtatggcacggcacagtcagaaggggcggatgggcaccagcacgggggcccagctagggagcatggacttcaggatgaggacaatagggacccactgcccagggcagacgtgatcagacttgcattgtagggaaatgactcaggcgtctggtatggaggggcggacttaagaatgtgagactagagacgggaaaccatcaagaaagttgccgttggactagtgacataaaagcaaaccctcagaggaagaatggacaggatttggtcatcaattccgtgcgagggcaacagagaagggtttaaaaatggtttctaggtttctggcatgggtgatgtgtggtttgaagaaggagcaggtgtgccaggagctgagaggtggccgtgggatgtgcaggaatggaggcgtggggtgacacagctggagatgtgcaggaggcacctgtatgtatgggtctgtttcttagacccaggctggagaaaagttgagaattagtcactggtatccacacagtggagaaagatcttctagggagactgtggaataaaaagagaaatgaagattaaggccgggcatgtggctcacgctgtaatcccagcactttgggaggctgaggtgggtggatcacttgagcccaggagttcaagaccagcctgagcaacacatcaagacctcatctcaattttataattaaataaataaaaattaaaagtaaaagatcaaggccccagagaacaacccattgctagaaaaagaccctaagtagaagaacaagagctggtatctctaaaaccaggagaggataccctcccaagacagagggataatgtaagccatcgaagggccagggtatttgtctggtttgtccacggccgtgtccttagtgcctagaacggtgcctgtcatagtaatagacactggtggatagtgagtggaggaaggccatcgggtaccccaggggttgaactgggcaagcctctccacattgctgaatgcagaagaggcgatggtggccttgtggccactcgggctgactgggtggcacagcgtggatagaagcctcactacgattgggtgaagagtgagaggcagatgagaaagggtggagacggctcttccaaaagagttggtgggagagggagaaaagaggaggtttggaatgatggtatggctaggaatttatttatttattttaatgaaggttatttttaaacatgttggaaggaatcagcaggagagggtgaagataaggaagtgagggcggaggtcttccaggagggagggtggtgtcggagcagaagggaggggctgcctttggccaggagggactgagatacctttttttttttttttttttttgagacggagtcttgctctgctgcccaggccagagtacagtggcatgatcttggctcactgcaacctccgcttcctgggttcaagtggttctcgtgcctcagctttccaagtagctgggctactggtacaggtgtgtaccaccacgcccagctaatttttgtgtttttagtagagatggggtttcaccaggttggtgaggctggtctcaaactcctgacctcaggcgatccacctgccttggcctcccaaagtgctgggattacaggtatgagccaccatgcccagccagggactgagagacttctgaagatgtagacaaatctgagatgaacttctgtgatccccggggcctcccatctaatcagaaataggcaagaggttataactgtcatggaatatgggcagaacctctgaccagggcatcacggggctggtcagcagcacagagggcccagatgagcctgtaaactgcattcataggaccatgtatggtcacctgtccaaaggtcacttcaggaaccagccccagcagaccgaagctggagatgtgagtggccagaactgagaacgctgaaatctagcggtgtttcttgggcaagcacccagacacttggtctgttgacttttgtactttacaaacacttctcacaaggctggctgtagtttttccaaccaggagccagattagaagtgatacatgtaacatgtgaagagaggacagaaggacccaagaagaagaaatgaaagtgaggctcagagcccatgtgtagtaacagggcagagagactcctgtgcccgcgtaggctgaaggcctgccctagggcgacacagagattccatctggccaaccctttcattcagccaggacttcctgagcatccacgctgtgccagatgcggtcctagacagtaaggagagagaagtatagctgtgaacacagcaggcacatgctggccctcagggagctgcctgagacacagtctgagccaggccctgtctccacagcagtgggagagaccccttggagaaagccagagtgtcactaacagagggcttcaaggtgctgtgagagcaaacggggcaactaatgctggggctggggtgacaggggagattaaaaaaagggcttcacgaaggacttggcagccatgctcgaccttgaagggttagttgacctcatagggcaggaggggcaggtgtctgggcagtgagaggggcttctgcagaggtgcaggggtgtgaaatgttctgctgatgcggaattgctaactgcctgcagtgggcacactgacttcccttgtctgtttagaagaacctctcttaggaaacagcattgggttggccacagtttgcctactcttgagaagagactttgccccacaagtggtgaggatgccagaagcttgttctcttccataaaacaggccccaaagggcttcctcctggaagtggttaattaatcatactaccttatatgtttacaaagcaccaccccataaattaccacctcacagcaactctacaaggcaggcggggctgacatcttcccctcttctaaatgagggaactgaagccagatgaggtatctggagagtgagaggctgagctagaggtgggctccaggccttgtgcctccccagctctgcacactgcccctgccctgctgtgagtgtgacaggacattcctgccatgcatcccctcctggaggaggaggacagagcagaagaggtgagcccagccacagagggagcagctaaatgaaccagggaatcctgaccatcatactgggctcatccgagcactgcctttcccctccccaaatgactgagctgccagtagagatgactgacggccactgagaaaccatgaagtcctggcccaagggacagtgtcaggcatgtctgagaataaggcatcctcagaatccagagtttgggccagaaaggcctcagttgtttgacaaacaacactccttgtttgacaaaggaggaacctggtctgcagaggaggtgaggtctgcccaggatgacccagcttggtgagtgaaagagctggaggcaacacccgcctcccaacccaagccctgtgtcccgtcaggctgaactgggcttcgtgctctaggcagcctctccttctctctcctatatccaaagagttctagtcctctctccccttcacccgtcaccactaccataaacccttactgcttacttatagcttgcccaggcattgttatacatactctagaaatagtaattcagttgttcttcaaaataaccccattaggcagacaccataattttccctgctctataagaaactggggcacaggaatgttaagcaattaaagcaaggacacacagctagtaagtggcaaggctgcaatgtaactccggggagtctggccctagtctgtgcccttgaccattgtggaagatggacacagtcccagatgggcacctaaacaccctttcactcacctacaactgccacctagctggcagtgtgtggtctcactttggagctgagtcaagctcagtcatgtaccaacatctcaggtttcccacacacagttgcacaatctcttacaccatcacaccctgtcatatcacatcacccctcaagcccttcagttagattcatggcttgttggtcatttagtgtcaactctgcacctccaccaccgtgctgggcaccagcaacatggatgcatcagacagaccatctccgtgctgaggtttactgtacagggagcacacggtaccttacagttagtcttctaaaggcgatgatggaaatgcgagcaagcacagtgggagcagggaaggaagagggagagggtgcttcgcccttagagcagggtttctcagcttggcactgtgatgtttctgctggtgttgtagaggcctgtcccatgcattggaggatgtttatcagcatccttggcttctgccctctagataccagtagccagtgtggcaaccaaaaatgtctctgggcattggcagatgtcctatggggtaccaaagccgtctctgtttgagaaccagttgcagtggagtgggaggggtggttctcgggaggaaggctttccagaggagtatctgtgcatgttctgaaaggtgattaggcccaagcaaaggtgtgaggtgtctaggtcgtatgagggagtcactgcgtgtgccttgtgagtcatagttggggtagaggagacactttattgcaagagctgagaagggcttcgggtgtggccacggcagtgggatgattcctctgtctaccgggaggcctggcctggcctggccttggtttggaggctagccatgtcagggctgttccagggaagcagcctgggtggtccagccctctgcaggggggttggggcccagctctagccccaacctgggcctcttcccccaggccccaaagtgaggccccaggggacccagtgggcagggttatctgtccagccccacctggaacatctggctccaatctcccagctcaccctggggtgtggctgagagttgctgtggagatgaaggccctgggctgagagcttgtgggaagggcagtgtggggccagccccaactggaagacaggggcaggcaaggaacaggggtgaaggccaggctgagaggctaagccggagaagctggccctttcctccttgtaactggcgctgaaagcttggctggcagtttagccccttcttccccacaatagcatcccgtagagcacagggagagttgagaccgagcctaaacctggcccagggatccctgctggggatgacctaactgacctagtcctcctggggtaaaggaatgtctagagggaaggatggtgagaccagccagaggttccaaaacgcatacccctcctggcagtggtctagaatcctagatcaagggttggcaggagggccacatccagccagcagcctgtttttgtgcaacccatgagctaacaatggtttttacatttttacaaggttgagaaaaaaagaacaatgagtgacagaggccatatgtggctcacagaccctacctaatggattctagctagccttttacataaaatgtttaccccagtccggctctggagcactttgacttgcatgctccctacttacagggaactcaccacctgtaaggtgggcagcctcataccctgaagtctataaagctcttccttcccctgagctggagtctggccctggcacctctgccctctggggctacagagtgctgggttcctctgccaggagcagccgagcagggtctggagactagctttattccctgaggcaggcccgtagttccttcaggttcctccttactcttacattcttagggtaatgatttctggcaatttcaaaatggaaaaccttgtccctaaggctcctccgaaagtggtgacttcttttcttgagagagcaacagtgacagcagtaacagcttacccatgtgccaggcagtgttcgccgcctcatgcccctctacaaaggggaagtgagaagttccttggcagatgggcagacatgtagtctcacccacagttgcctcgactggcgggaggtggtgtggggattcccaggtgtccttaggcttgggcaggcctccccctcaccccaggagagccaccgggtgaggaatagcttcgcgtaccagaagccatccggttcaaaggatctcagctgcccagagtcaacctgcttctccagggtggtctccatggtgggtgtcctctaggctcagtgaggcacctggacagagatctgtagtagcccctcagctctaggctggccgacaccatggcagtccccccaggaactaaccagaaccgctcctccctcctcaacacgcttgccgccacccagactccacagctgggtgaagagactgggctgggaagggagcagagaagcgggtggatggccgagcctggcacatttggtgtgcaggactccgactgcattctgaggggtggttcactgtgggaaatggggtctgactttggtggataggaagagtcgggagcagaatccagatgagacccagggcaggctgcctgggtagagaagtaggacagactcggaggcagaatcgagaggacctggtgatggatggatgtggggtggtggcagcatcaagtgtttaaatcctaagcttgggacgggcatgtgaggtgggagcgttcagaacaggcacgtgccaggtctcacctcacacatgacccagggttgcggaggctgctgggagccggcgggattgggcctgtgggatcctgtcagggcataataagtagactcttctttcctgaggtgcacccagacacttctagggaggatgtgaccccagagcttttccccatgtagggttcttctcattctccagcatccccctgcctttcctgggccaagagtcagcgtggaaccccatacgaatccccagggaggagagggcacagagcaccggaaccagcagtaggaattggaaaaccaggcgtggcttcttcccagaaatctcaggcatcaagaggcagaaacccactccccagcctcagcttggccaggaagtgctgctgtgggctggagaggatgggtctaggccaaggtgaacatgcagagagctggctgctcacccttcctccaccccataaagtggtctgagtaacagagcagctaggcagcgtccaggagccagccctggacaaggttgggtccctttgactgtgtgaccacaggcaggagacgtaactcagggtggagctctggtcacacctcacttacacacagccctcttgtcagttgccccaacatctcaagagatcttcaagcttatttaggtagtttcaagccttacttagcacctatttactctttctttgtatacaattcaaacaaattccatttgctgacttcttggcaaatttcaaaagaggtgtggagagttgtacaagacaagcctctgaaccacagagggttgggggaataccttagaactatggaatgcagaaatttagccatcaggagccagtctgcacagggacaaacacctctccttgcccctggagagagccccaagggcagacaccattgccctgcagccctgcttgtaggtctggttgctcaggagagcaaagtgaaatctcttcacattttcaccccataatgggtcaggaaagattggaccctcagaagggcaagcgccatttatctggaccgttcccatatccaccctcattcagagcagcctgttcttggtggagcctgataaacggggcattaccgttcccaaccagtcctcctctggggttagtttcgtccacagaagaacactttgcattttgttactctgttttttgtcaaaatctgccttctgtctgcccccagcagaatcaaggggttctaagaggagagcctaacacctttggttcgattcctccatttcctcaccaggtatccctggcactggctctgggacagaccatggtgtgaatcaactgtcttcctcagggaagacaaactcctggagtcagggaaacctggatctcgaaaggtttcagcaataaggccaggggtaccttccaggcaggagtagtagcatctcaaaggcgtagaggggtgggagatggtgtgtagtgagtgcaaaggtgtggtaggtagggagattggattgatacctggcaggagccccgattttgagttacgggttgaaggcttggggagactctgttagtggtctgcacagccttcaggccaccagtgtgcagtggggtgattttagggatgatgacaccaagcactgtttcactgattccctgcagcactgtgaagcagctcctgctaatgtctgcactttagaaatggggccatggaaactcacagatgaaataacttgctcatggtcacactggaaataaggggtggagctaggacctgaatttagttgtgtccagaatcagagttcaggtttctattcactgccctgcatggcgtccttggaacggacaagcagatccttagggcttgcctctgccctaccaactgtcctcgccccttggagcctggcctccatcagatgcctgctgacttgggacaggttgtgacagggcaggggaaaagatggctagaggctgagcacccacagcaatgggaaggaaggcaccaggaggcaggcccagcatatttgaataggtgggcatttctgggactgcaggctttggtttggcaagtgtgcctgcccacaccttcttcttctgctagacctcagtgggttggaagggatagggaggaccaacagcagtgatggaggctgcagaggctgcataccgctgtgtgtgcatgaacctgtggcatgcacacacacggaggggtgttgggatgggttgggttcacatggaattgagtttgagctgtaagtggtaggggatgaggggcatgtgagtttgtgactggctaaagcaggaatatttagattctatgagcacgggtatgtgtgtgtgatggtatacgtgcataagaagccgtttctgggtaactagggcctgcactctgctatacgtgtggctgggtgggtctggccagtcccatggcactgagagtgtggtgagtgtgctcaggcagaacgggtgctgcctgcctaccacatccgtgggagctggccagggtgggggcagggctggtgggcagggctgccctaggacgggcgtttccagttcctggaactgcttccttgtgtggaacctttccccatacctcctagctgggcccttgggagaggggaggaggccgtgggtccttcaagggggtgctcgcaggccagacacaagggagctaggcctggggaacagaaagccacagcgtgagtctttcaagcacttctgaagggtgacatgtgtgagtttgtcacaccaggccctcagtgcggtcagggagtctgtacttcctggatggcggaacctgtctgtcaagccctgcttcctccccagcaaggggttggggggagggcctgatggcaggagatgggcccctggggctttgagacatggtgaggagaaaaggggcaagtgggaagacccttttccttctgtatttctctttttttttttttttttttgagacatagagtctcactctgtcactcaggctgaagtgcagtggcacagtcttggctcactgcaaactccgtgtcctgggtttaagcaattctgccttagcctcccgtgtagctgggattacatgcttgcgccaccacgtccagctaattttttttttatttttagtagagatagggtttcaccatgttggtctggctggtctcgaactcctgatctccagtgatctgcttgccttgatctcccaaagtgctgggattacaggcgtgagccaccacacctggtcttgtacctctctgttctatgcctgaacttccaccactgatcacttgccatcatcccagcaagtcacactgagcctgtgaaaccacagggcactggaaaccacacgttaggggaagtgggagagttggcggggctctcagatgaactccaaccccttgtttctcgcctggggaaagtgaggcccacaaaaatagagggacttggctcaagaacatgcagtgaatctgtggcagagccaggccctggccctctcttagggaggggtgcaaggggaaaggaaaaggaagactgggtcctggcccctggcttgctcacccaggctgcatctccccctgcaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggtaagtaggagaggtcctggcactgcccttggagggcccatgccctcctgcccagggagtcccagatggggtgggaggtaggggagacttatctgcctgttccagggtattacctctgacccagcccctcggagcccaaggaatgtgggcactggcctgacctgtgaccccgtccccaggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgtccccaaaaccctcttgtggcagagtagcagcccccattctctgtgctggacacatctgtggccttgtcatttgtcctcccagcaacactgtggggtaggtcctacttttcccatgtgaccgatgaggaaactgagaaacagggctcatgctagtggcagagcctctagaactggggcccttccctgaagcagcagctgacacaaagtagggaaggccactctggcaggacggggtgggaaagggggtcagggcagaggcgctcacggcccctgcttcccccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtggtacgggcatggccctgccctcctccccactccctgagccctggccttcttcccactctgagccaccctcaccttccctccggtccccccagtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtgagtgcccccacccacccttcctgtgccccagccaagccctctggtcaagtgtgcatggtgaacaagtcccaaacttgaaacaacagatacgcctctgccgaagaagtttccctttagaccccaagcccgtaaggtcactgcagtgcagtgtcccttctgcctgagtatttgtccccttcattctttactcatcctgggtcccacatccactgctacagaggcagggaagggccacaatgtccaggtaggccccaacagtttctcttgtctggcaggtcttctattactccacgagcatcttcgagaaggcgggggtgcagcagcctgtgtatgccaccattggctccggtatcgtcaacacggccttcactgtcgtgtcggtgagtctttgcttactggcccccccagccaaaccccagggaggaggcagtgccatcttccccactggtctttgcagtgccctgtgactttctcagctcttgaggcaaggcctctgggtgggtgggttcagaagggcactaggcaggggtggcactgacactgtctctgcccacagctgtttgtggtggagcgagcaggccggcggaccctgcacctcataggcctcgctggcatggcgggttgtgccatactcatgaccatcgcgctagcactgctggtgagttgctaggttctggagagtgagggatgcgggagagtttgcctgggcttcatatcccaaaatgcctgtctcagccccaggctggcaggccttttggtggctgcattctccctggctgtgggtctgactttctggctcctgaagttgtctccttccaaaccacacacatcctctcttgaacttgctcctccctgcttgatggattctcagcgcagcacctctggtcccagaccccaaactctcacctccttaaggaattgctttgcctaatattaaccctttccaatcttcatctgtagcctcaattcatcttcacagcaaccccgggaagtagtgctgtcctccccatagaggcgcagaaacatgccttgcctcattcagttcacacgactggaggtgtagttcagttcttcccattttatgggggaggaagcttaagtcccagtgaggttagtaacttgtcagataaaggatgaagccaggaatcaacctcagtcccaggcctgtgactgtgaccgctgtgctaaccctgtgcctggcactcacacacaggcactcgtttatttagcctctgggcaaggaaagcaccatgactgtcattttacagctcaacctgggcttggaaagtttggtggttgccgaaaggccagacaggcagcaagtggaaagcccataaattttctaccctggcctcctcaagaatggttatatgcagaaccgtatgcttagcgcttactctgtgccagcctgagctgggcacctcacacgccttagaacctgaatccaccccacccccaggaatgttctgcatcctgccacaggcggactgtgctgcaggcacagacaggggaccatggggcctcttagcaccgtccacatgcacaccacattaccactcccagcgggtggactcaacacttgcagccaccctgcaggacttaaatcattttgttcggatgaggaaacttaggcccaatgctggatacacaacaaatccaggaccatccccaggcttcctgccttctcgcatagctctgctctggcctctgtagcttctgtttcccctgaggatccatcacaacccagtctaacttttccccctctccgtcatcctcaacaggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggaggtgagaacccccactgtctctatactcacccgcacgcatgaccccacagtgctgtgcaaagtgctggcccagcattctcattaggaatcatgctgaggaggaaactgagggtaggaagcccaggtcacatgaccaagaatgctgacctcaactccagggttctccccttagccttgaatggtgctcctggagcctgttacattctaggtacaagcgtggtctcagttaattatgatagcatccctgggtaggtggatgttcccttttcagctcaaaggcccaaaggtaaagtgacttatccaaagtcctacagccaggatgtagggtcatgactccaaccaagtgtgtctgtgtgtctttcagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtc

SEQ ID NO: 16 - DNA, 1449 bp, homo sapiens
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 17 - DNA, 1572 bp, homo sapiens
gtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaaaaaaaaaaaaaaaaaaaaaaaa

SEQ ID NO: 18 - DNA, 1594 bp, homo sapiens
cttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaaaaaaaaaaaaaaaaaaaaaaaa

SEQ ID NO: 19 - DNA, 1478 bp, homo sapiens
aaaagggcaggggtcattagagaagatcggggacacatgtggggcgggcaggagctgccttataaccagcccgggaacccctagctcactcgctgctgaccaggctctgccggctccttcggcctcgccgcaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaa

SEQ ID NO: 20 - DNA, 2353 bp, homo sapiens
cctagcttggcgcggaatccgtgaattgcccgcggcccgagggtgcagctcccggactgactggctctgcccttccccatggacgcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaaaaaaaaaaaaaaaaaaaaaaaa

SEQ ID NO: 21 - DNA, 934 bp, homo sapiens
cagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctacaagctcctgcttttggctttaccatatgttgtgtctaatctccttctgagaaggacgagaaactttcttccaagtgaagatccatttaagaacacatgtatttacatgcctataatatgctggttgtgtatgctttgtcttttaagttattaaaggaacgtcta

SEQ ID NO: 22 - DNA, 1535 bp, homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 23 - DNA, 3505 bp, homo sapiens
cgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttaaaaa

SEQ ID NO: 24 - DNA, 838 bp, homo sapiens
cttcccactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccata

SEQ ID NO: 25 - DNA, 2722 bp, homo sapiens
gagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattctaa

SEQ ID NO: 26 - DNA, 3081 bp, homo sapiens
attagaggctccagccccgccgacttgcagacgtgagatcgggcacacctgagcggcggcggggcggtcgtggccacatccggggcgacgtgcctgagtcaccccgtcccgccagcgtctgccagtccagccagtccgcccagtctctcgcgtccgagactcgcctccagcctcccacctccgcccgggccgcgcgagcctcgcgggggcgggggcggggcgccaaggggcggggctgtctcttaaagggccccgggccgctgcccttaggccacttcctgggggcggagaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctcctcctgtgccctcttcgcccccctcctttgggggccccgtgaccctgaatgtggggggcacactatattccaccactttggagaccctgacccgcttcccagactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccggcactgaggatgctgttctcagtttgactgtggggaggagagagaatggggtactagcacccctgaagcctctttccagctctgcttcaggagctatgagagtcgggactctcctgcacctgactggagctcagatgtgggcaggaattcccaaacctgagcccaccaaggactcacaagtggtccagaaggtctcaacctgtgctgaccctgggaggggtagggaaggttctctcagcttgttcttgcctaaggctgagcacctccagtctctccttgatttggagctcagtgtttaagggcttggaaaaggggggaacatctctttacccagactagacctagcaaaaccctggaaggatattgaggtctggggaaaagggaggactttgcattttcccaatgcggtctcttggaccatggcttctactcctgaagctgggtggcctggcctggcctgaccaatgagaggccagaacactctggaacatcggaagaggagttctttgctatgttccaagccatctactgagggaggcagaaaggccacaacccaccctaggttgatgtatgggagctaggacagtccccatggcaatggggctggagcatccctcatctggaagaatcccatactgatggcagggctggccagggggaagagggtagtatctgtgggtcctggcctttcttcatgtgtgcgtgcatatcagcccgtgtggctgactgatgtataggtccctggcatcctggttcatatctgtgttgctgactacagtgtctgtgatgtccgcatgtccaggcctgtttggggttgcctagcgactcttctggcacagggtgtgtctgtggtatacctgtgaggtggttgacaattagtagtttaatcacagggtgtgtgtgtgtgtgtgtgtgtgtgtgtttatgtgcacgcatgtatatgcatcaccacgtagccaggaggggcctgttggggtttgagtcactgggatcttcctggtgagaggtaagagaagtcactgggcttagctgggcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaaccacaaaaaaaaaaaaaaaaaaaaaaaaaaaa

SEQ ID NO: 27 - DNA, 3925 bp, homo sapiens
attacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaaaaaaaaaaaaaaaaaaaaa

SEQ ID NO: 28 - DNA, 5177 bp, homo sapiens
attacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatagtcacacttataaacattcccaatattcggattctagaagaaatgcaattcattaaaattttcctggcactgagagttaatctttagcagattgcatgaaaatactgaattcctggtaaggagatattttgttttaaaaataatgtgttttgatacgaatcagtgtattaactgataactaaaaagtactcttttttctatatatacatatttttttgaactcatattcacaatcaacatattcaatcagtgagttaagtctcattcctagctaccaaaattcctgggccacttttaaacactaaacatttcatttatcctctaagctaaaatggtgctgagttatttaaatctgaatgtaaaatgcattaaatcttagcttgtggtatataaacatttaattaatataaaactgcttgctataaactaagtaacatgtcatttggtgttaggtttttagtgaagttttagcttctcccaaatttttcaggaatgttatttgtaagacgtgtaacttttttgaagaactcttattttaaatgctcagacattggctttatgttcctctttgcattctcatattcttttattatacatctatactatgattgcaagattatataaaaatgccttgaataaatgatttcaagtgtc

SEQ ID NO: 29 - DNA, 3520 bp, homo sapiens
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 30 - DNA, 3123 bp, homo sapiens
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 31 - DNA, 2860 bp, homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaaaaaaaa

SEQ ID NO: 32 - DNA, 2953 bp, homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccagagatgaagtcttgctatgttgcccggcctggtctcaaactcctgagctcaagtgatcctctttccttggcctcccaaagtactgggattacaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaaaaaaaa

SEQ ID NO: 33 - DNA, 2806 bp, homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacagaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaaaaaaaa

SEQ ID NO: 34 - DNA, 2860 bp, homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaaaaaaaa

SEQ ID NO: 35 - DNA, 2582 bp, homo sapiens
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 36 - DNA, 2110 bp, homo sapiens
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 37 - DNA, 2246 bp, homo sapiens
aagggaggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 38 - DNA, 2252 bp, homo sapiens
aagggaggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 39 - DNA, 2588 bp, homo sapiens
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 40 - DNA, 4576 bp, homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaa

SEQ ID NO: 41 - DNA, 4224 bp, homo sapiens
ctttcccctccctcgcccgccccgccgcccgcaggcgccccgagtcgcggggctgccgcttggacgtcgtcctgtctgggtgtcgcgggccggccccgcggggagcgcccccggcgcgatgcccttcaggaaagcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaa

SEQ ID NO: 42 - DNA, 4553 bp, homo sapiens
acgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaggcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaaaaa

SEQ ID NO: 43 - DNA, 3687 bp, homo sapiens
tccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtcaaaaaaaaaaaaaaaaa

SEQ ID NO: 44 - DNA, 2728 bp, homo sapiens
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattacaaaaaaaaaaaaaaaa

SEQ ID NO: 45 - DNA, 3599 bp, homo sapiens
gtagtccccgcctcttccccaggggccgcgtcggagcctcggcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataaaa

SEQ ID NO: 46 - DNA, 434 bp, homo sapiens
acttccgctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaa

SEQ ID NO: 47 - DNA, 24 bp, homo sapiens
gctacaacactggagtcatcaatg

SEQ ID NO: 48 - DNA, 24 bp, homo sapiens
tgtctggttgtagaactcctcgat

SEQ ID NO: 49 - DNA, 14 bp, homo sapiens
ccccccagaaggtg

SEQ ID NO: 50 - DNA, 21 bp, homo sapiens
tgtggttcctgcatgaagaca

SEQ ID NO: 51 - DNA, 24 bp, homo sapiens
gtgacagcggaagtggtattgtac

SEQ ID NO: 52 - DNA, 18 bp, homo sapiens
tggctggcggtgcctgga

SEQ ID NO: 53 - DNA, 68631 bp, homo sapiens
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtaagggggcttacgggcgggggtggggaaactgaggcggaggaaggaagatggcgggggagggaggaggccgggaaatgaatggtgcggcgaggtgccgccgccggctgtcagtcctagacccgccggccagcgaggggtggggcccgcagccagggcctcgcgggtcccctcgtttctccctcctgggactggggcgggggcgcgggcccgagattcaacccccaaccctcccagcggctttctccgcgcgacccctcccggcccttcccccactacggtgggcagcgccgcccaaagggcgctggggacggtcgtcttgggggtggtccccgggcccgacccatccggctttcctttccctccgcgcccgtttttgccagtcggtttggggacccaggggccgagctcggggactggcctggcaggggagctagaaaagagaagcgctcctggtaggtttgacaagatcgctgtgacaacattctgcccagggtgtgggtggggaaagggaagaatcggactctgaaaatgggaacctacagtggggctttcatttgaccacccaccttctcctttcgactcctggtcatttccatctccctctgcgttttaaccggtgaaccaagtcacattttaattcgagggagaaagatgtcatgtgttacttctgtagcctcaaaaaagtcccccagtgagcaagcgcgctgcaacttccttagttttgtcaaagccgcttcctgctttcagtcttttatacccttataaggtagtttttagtttccaacctgagcacatcttactagaacttttaagcaggttttaaagagactgaattaccggtgcttggtgtccatttatatgacttaaaaaaatgtacttatgtttcatggagtgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctatgtatttttttgatgaacactttatttaaaagtttttccttaattcagtctcatttctctgaaccaataattttttttatttctcccttcttagtctaattggtgagtatttttatgtctaggttcagttttaaaattagatttggcctgagtcagtaggataggacttttcaaatgtgttttgttaaagtgacgaatattgctacataattaatgctttagaaattactgcgttttcaaaaaaatagtgtaaataattgtggccctgagaaataatatggtaacatctcaagtagtatgttacttttctaatctccattttcccccttttgaaatagtttcgaattagtatacaagatgtttcattgagataaactgtccttaagtgacctcctttcctaaagggcaaccttgaatttaaaacatgctgaatgaccagtaggatcgggaagaggggttcaatttaacctaggctatttctgttttaaaattacgattatcacaatagtgtatttttaagttattacattggtttctccaataaggagaggttattaactgcacattgatgatttgaatggaactgattaggagtccccttgccacctcactctcttttaccatttgtcacaatctgaaattccccctttagagtttcagttattttggttctcaaaagcctttttggtcttacaagtttccagtggtgcctcctgggaagttacaccttcagctttatttgcacatggaggataagtccttgaggttgaggaccctgagataaacatctctaagtatggccttaacagggagcttttacatttcaaaattctgtggtccccgaatgcaaattgtgcacctgtaatttgtctaattttttttatgctttagagaatgcattcagctctgaggtctctaaattacaattactcacttagtttaagtaaaaagttataacctgaatcaggttgctcatttcattcattatataaattaggggaaaggtggctgaaaaaaagtggccatctgtaaaacttgatcgtcttagataggaaagctgttaagagttaggaaacttgaaacttaagcccaaaacttttagggatcgtccagcaaaactcaacatatgaatcacctagattcaggtcataaaagagaatacttattttgaaaagaatttgaaaagaaatgcttcattcacattgatacccttatctacacacttttttggtctgtattggaaagcattgtaaaatacagttggggcacatagattcccattggtggcttgaaaactaaataacagaactcaaacctgctattagtggtgagaaaagcattttctttaaaaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcgctccttattaactccttgttatatcgtagcttggttacagagctgcattgtgaatttccttttcccttttatgtctttttttttcccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatatcttgtaggtgtcagtgaaagaggagtatgttcatcttgtggccacaattcagcaattagtgcagataagaatgatcttgtttgaagagcagtggggaaaagctgggtaaatgaaggaaggtatatgtgggaagttcatgtttcttccatgaattctgtgcgtattgtttaataataatgctgtttctttttttttttttgagatggagttttgctctcatcgcccaggctggagtgcagtggcatgatcttggctcactgcaacctccttctgcctcctgggttcaggtgattttctgcctcagcctcccaagtagctgggattataggcgcccactaccacgcccagctaaattttgtatttttagtagagacagagtttcaccatgttggccaggctgttgttgaactcctgacctcaggtgatccacccacctcatcctcccagagtgctgggattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaatctcagccttatgaatttgattcacctaattagagaaaaccctctgtgtaatctttacttggtttaggttccccccccccacccccctgccgatatgtgaatgcctagactatttccttgttactttgcttaaatttaatctctagaaaaaaattactctctaggttgtgtttctcaggaaataataatagctagcatttatcgagaattgtatgtcagcccctgtgctaaatgctttatattatctcattaactttcacaacaacctggaaagtattatctttgttttataggctagaaaatttagtcttaagagaggttaagctacttacccaagatactgtagcaagtaagtatggcagagccactacactagatcttccttccgtagaagatgaacgtttgacatggcttggtgcatagtaggaattcaaatctttgttgtatgaatgaatgaacaagaattaggagtatggtttttaaaaaaactgtgcatcagaaacaccccatacccagtgactcagaatctcaagggttggactatgaatattcatttacataggcttcctagatgattcttcagcagcccattcaagggctaactttgcagaaattctgaaacctggtattggcggtggagttggagcagaagagataagttaggaaaagattggttttttcctttctttttacgtttcttctggcagttatatttcgtgttattttatttacgggtagcaaaggctttgtagttatctgttgttgagttcaagctctatcacttaatagctatatgactttatacacttcaacctctgcaggtcttatttcttcccatctgtaatttggagatgatagtgtataccttataggttttttttgtttgtttttgagactgggtctctgttgcccaaactggagttcaatggcaagatcatggctcactgcatcctcaaactcctatgttcaagctgtcttcctgcctcagtcccccgagtagctgggactacaggcacatgccaccatgtgtggctacttttaaaaattttttgtagagatggggtctcactgtgttgcctcaggctggtctcaaacttctagcacaagtaatcctcttgccctgacctcttaaagtgttgagattacaggagtgagccaccatgcccagttttgttttgttttgttctgttttttgataatgtgtgaaaatggttcagcacagtgcctggcacacagtaagggcacaatatattttaaatataataattggttggctttcttttttttttgagtttcagttcttaaagaaaggaatacagtgtgttatgcttattttcttatctcctgcaggccttggcctgcctaccacacacagttctctgcacagtcaaaatgtttttgctgatttgagagattgaaggaggtatagctaggacttggcagttgattccagtggattgtaaataggcatcaatgaatagttcaagattgtaagcctgagtgattgggacaataagggagttagttttaagaaactgagtaaaattggaatttgttgttgaatttggaatgatgatttataattggaaacattctagaggaaattaaaaatacaggacctttgggaatgaaggtggatatttgggaatcataatttgttaactgaagctaataagatgagagcattcagagagaaaagaacggaaagattgaatatcagtttcccttctttaaaaaaattgtggatatgtgatctagcttcttgagcatcacagtgactgattggctcgtggtaattgatcgctatgctgacaatcttatctccacctatgtcattcaattttctaagaggcaaaatccttaatcaggaggagagtttagctctagctaaatttcccttgtccagcatgctcctgctcccccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaaaaaaaagaaaaaaaattctagtttttttaaaggacgattttgcagaattttaataataattttgtttcagaattttcaaaattctttccaaactgtcgatttaaactcaagccattcttacatactccttggaaccaggaaaggaatagcttgaatttgtgtggccagatgttattttttttttttttttttttttttttgaggcagagtgttgctctgtcacccaggctagagtgcagtggcgtgatcttggcttgctgaaacctccgtctccagggttcaagctattcttctgcctcagcctcccgagtagctggaattataggcacccgccacgatgcctggctaatttttgtgtttttagtagagaccgggtttcaccatattggccaggctgatattgaactcctgaactcaagtgatccacccgtctcggccagatgtattctttcagctttccttctgctccccaaccctaatacatacctgagaagaatattcatctgttcggatactcaacatgccatgttttcctcctgccgaaggacattacctaaacgttttatttttaaacattttgtccttgctttaagactttgtgtcatttgtgaaaatgcaatgctcttgggaagggtttctgtgcttttcagtatttagtgtaaaggagaggttacaatgaggaggataaaagtcctagagagagaattagggtgcagaagaccttgtagtttagggttggcttaatctactgtaaacatgtaaaccatgtttttagtattagtgtatgacaggacacaagtgtttgcctagttatagagattattttagttaaatctagtgtgcttctgctataagcatttttaaaattcagttactcaagggtacaaatatagcatttaatgtgtatttgtgaaacttgctttagtaaattaagggaaatgcctaatgactcacacagaattatagagctgaaaagggattttgagagataatttaatccagtcttcatttacaaatgaaacagaggctcagagttgagaaatgtcttttgggagtgttcctaattattaattgatagtattgttgagttctcttaaattttcttgtgagttcacatttatgagttaatagttgaaattaagtaattggaataacataatgtattttatttatagttaaagtagttttagttgaagcctacatcagaattcttcagtgtttcgttgtaatgcagaggcatactgtatggcacacatgagaaactaattttatgtttcccaataataatgttttaaaccaagtttagagatattttaaaagttgtgctctgtaggtgccaggacagatgactttcataaaatgaatgctctctttaaaaaaatttttctttatggtttcagagatttatatctttggattttaattattaaagatgtattaaatgggatgtgtaccaatcagccatttcaaggccctttgcacgttttgttttggatgttattaccttttcagaagccctgtgaggtagttactgttataaataatcccatttcaaagataagtagtagatttagaattttagtcctggggtagtctcattccagagctcactgctctactgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatatttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgggcagattaataagggctgtagtatttggaggatgatttatgaagaagctgaacttgatcagatccttggaaaagcataaataggatgtgatagatatatgggaagaaggacttcaaatctaggatgtgagctaaattgaaagctccatagtggcagggattatttcttttttgtgcattctctattcaagtgatagcgtcctgcatgatatttaataatgcccagcaaatattttactgataaagggaagtcatgaaggagtttcaaagtatttgggggatgggtcagttaggaaattgccctgcctggaattcagatatttctgttgggagctgtgggacagcaagtagtttatttactcatcttgccttatttcagaaggattttaaatggggcagaatggtttgcgatttatttgatagacagtagtggattgtgtagatcattaagcaaaagagtgataaaaggtaaatttatgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcgtccaggttcttcactcaacagtccatcagtatttttgtgtcaggttaaacattgacttgcatgtcatgagaaaaatgttggagggaattggaaaagttttttaaaccattgctgtttatctttatagctaatattgtcttactctacttgacaaatttccctgtgaatcagccactgcattcttgttttaaaagtttctggctgggcacggtggctcatgcctgtaatcccagcactttgggaggccgaggccgcagatcacctgaggtcgggagtttgagaccagcctgaccaacacggagaaaccccatctctactaaaaacacaaaattagctgggcgtggtggcgtgtgcctgtaatcccagctacttgggaggctgaggcaggagaattgcttgaatccagctactcgggaggctgagtcaggagaatcgcttgaacctgggaggcagaggttgtggtgggccaagatcgcgctgtcgcacttcagcctgggcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggaaagagttgtgctagatcattaaagtctcttctatccttaagctctggggtcttatatttattttgttatatcatttcatttgttgaactattgaaagttaaaacttgttccgtatgtagaggcacaggcagagtagatttagcatcattcttaagggccctataattttcagaattgtaatggaacattggcttcaaagtcaccactatattagcccctagcaagagagtgtaattgtacatgttttaatgtacaagcatttgcaatttgtaaaattaaaaataatatccaaggcaaaggatgttaatgcttttacaatgcaggcataagttgttttactactgaaaaagattctattaatggatttcttttaggtaggtacaatcaataatataacagatacctgcatttgttagaattatgacccgtgaacatttaattatacttactttatctttcttgttttaaggaacaaaagagcattattgatgactgtccccaaatccacttcccctttcctcagaggcagttactgttgtgacagactcgccttttttttggtataaaactcatctttcttttgctgttgatttctgccagtccagcctcctctctcacctagccttcttatatttctactattattcttctagtcaccaaggctttgatagcttcaaaagtgcttttgaattcttttctctatattcctttctctaagcaagttgtttttctttttttttttatgtaaaatgatgtattatatattttatacaagcaaattgagtacagctaaacctcagctacaggattttagagtacaatagcaagttgttttttaagtcccttaccatctccctttcgcagccaaaatcagcattgtagatttttttcattactgccatagtaagagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctcctgcctcagcctcctgagtagctgaaattacaggtgcccgtcaccacgcctggctagtttttgtatttttagtagagatggggtttcgccgtgttggccagggtggcctcaaactcctgacctcaggtgatcgcccgcctgggcctcccaaagtgctgggattacagggatgagccactgcttctggccacaacatggtgttttgatataagtaaaccttgtgtcatgagtcttacaatcaagctaattaatgtatttgttacctgacatagttaccttttttgtgtgatgacacttaagatcgcctttaggcaaatttcaactgtaaaatactgtatgttattaactgtggttactatgctatagcttagatcactagtacttattcatcttataactggaaacttgtatacattgatcaacagctctccaattcctccatttcccaatacctggcaactgccgtgctacttatttatcaggttctattttagatccccatatatgagtacattgttttccttatctttgattttcagtggtttgtgcctaagtgtggttttctttatatttattctgcttgggtgttcttgagcctcttaaatctctaaatttctgtctttcactaaattgggaaaatttttagctactattcctttttatttgtttgtttctgagactgagtcttgctctgttgcccaggctggagtgcagtggcgcagccttggcccactgcaacctctgtctcccaggttcagcaattcttgtgcctcagcttcctgagtagctgggattacaggcttacaccaccatgctctgctaattgtctttttttttttttttttgagacggagtctcgctccgttgctgggctagagtgcagtagcgcgatctcggctcactgaaacctctgcctcctgggttaaagcaattctcctgcctcagcctcccataatttatttttagtagagatggagtctcgccgtgtgggccatgctggtcttgaactcctggcctcaagtgatctacccacttcggcctccctaagtgctgggattacaggcgtgagccaccccgtctggcctgtcactatttctttttaaaaatatttttactacactctcttctccttctgggacctaagtgtgtcactttttttttttttgagacagagtcttactctgttgccaaggctggagtgcagtggtttgatctcagctcactgcaagttctgcctcctgggttcatgccattctcccgcctcagcctcctgagtagctgggaccacaggtgcctggcactgcgcccggctaattttattattgtgtttttagtagagacggggtttctccttgttagccaggatggtctcgatctcctgacctcgtgatccgcccacctcggcctcccagagtgctgggattacaggtgtgagccactgcacctggccacgtgtatcacctttttgatattgtccttgatgagtccctgaagctctttcctttttccttgttttctttccccccaatttcagaatgaataatttctactgcttggcctttattttcatttatctggtgatatttcctttattatcaattacaggtctatgttaatactcattgttgattggaagtctttatcttataattccagcatttgggtcatgttagaattgccttctgttgagtgtcttctcccaggagaatgggttatgttttcctggttcttcctatgtgaagtaattttggtttgtatgaatataacactcttgtttattcgttctcttgttaaacatttgtttttcttccagttttgggtctttatgaactattctgttgtgaacatacatgtacacaattgtgtggacaactgtttttatttttcttgtttctagtagattctaactagaggtagaattcctgggtcagatggtaagtgatagttaaattgttttcgtaagtggctgcatcattttgcattctaactagtaatgttttttattttgttgttgttgttatacaaccctccctccaactagtaatgtttgaaagcacctcagtgcacttttaatttgcattttaaaaatcccatggagttgagtctcttttcatttaataaccatttctgttgttctgggaatggttagtgtctttttgcctttccttcttttgtttcctcccttcctgtccttccctcccttgtcattaacatctaggtaccctttatatgttaaagagattatatctgtctagataatttgtgtagataatttttctctgttactcatttttcttttggctactttgggtgtgtttttgtaaagaagtttttaatttttacatagttgaaataaccttttatagtgtatgggttttaagttatagttagaaagtctcctgcactccagggttataaactatatcacattttcttttaaactttatatttgatacatttagatttatcctgctttaacatgtgcggtaggtatccagtattattttcttggtggtaactgctgaggctggcaggtcacgaggtcaggagttcaaggccagcctggccaacatggtgaaaccctgtctctactaaaaatacaaaaattagctgggcatggtggtggatgcctgtagtcttagctacttgggaggctgaggcaggagaatcgcttgaacccaggaggcagaggttgcagtgagccgagatggcgccacgggactccagcctaggcgacagaacaagactccgtctcaaaaaaaaaaaaaaattttttttttgtggtataatactcataaagtttactgtttaactatttctaagtgtgcagtttagtggcataaagtacattcacattattgtctaaccatcaccatcctccatgatccataacttttttatcttcccaaactgaaactctgcgcattaagcagtaacttcccgttctctcctcacatgcgaagtcccaggcaaataccattccactttctgtctttatgaatttgacttttctaggtaccttctataagtggaattgtacaatagttgtccttttgtgattggtttattttacttataatgtattcaaggttcatccatgttgtaagcatgtatcatgtgtttcctttttgaggctgaataatattccattggaagtatatatcatattttgtttatccattcacatgttgatggatgcttgggttgcttccaccttttagctattgcagatattgctgctatgaacatgcatgtataagtacctgttcaagttcctgctttcagttcttttgggtatatacccagaagtggaattgttgggtcgtgtaattactgtatttaatttttggaggaactattttatagttttccacagcattgcaccattttaaactctcaccagcattgcacaagggtttcagtttctttacatcttccccaacatttgttattttcttgataatagccatcctaatgggtgtaatggggtatttcattctggttttgatttgcattttctttattattagtaaggttgaacatcttttcttgtgtttattggccatttgtatattttctttggagaaatgtcattacaggttgattgctgatttttcagttgggctttttttgattgttgtgttgttctttattctggatattaatcccttacagatagtgatttgcaaatattttctcccattctgtggattgcctttccactgttgatagtgtcctttgatacacaagtttttaattttgatgaagtttttctctttttttcttttgttacttgtgcttttggtgtcatagccaagagatcatagccaaatttagtatcatgaagcttttcaccttatgttttttttctaagagttctatagttttagctcttgtgtttaggtctgtgatcaactttgagttaacttttgtgtatggtgtaaggtaaaggtacaacttcattcttttgcatgtggatatccagttttccagcaccatttgttcaaaagactgtcctttcttcatcttagtagttatggcatccttgttaaaaatcatttaattatatatgtgagagtttatttctgggctcctgattctgttagttcttatgccagtaccatactgttttggtcactatagctttgtagtaacttttaaaatgaggaagtgtgagatctccaactttgttctttttcaggattattttggctattcaggatcctttgagatccatatgaatgttaggatggatttttctatttctgcaaaaatgttattaggattttgatgggaaatgcttgaatctgtggatcgatttgggtaaatagctttcagatatgaaagtttgtcccaagtctgaattctgtactaaatgcaattatccagatggcaaatttaagaaaaaatgaagccatttaaacttatttttaaagcttattaggagggaatgagatcaggttgtttactagctgtccaaaagagagtttttgctaaatgtaacttagagcaggggagaaggtgcttttatgaattacttttttgtttattttttattgtaattttataataattttttaaagacggggtcttgctctgttgcccaactgaagtgcagtggggcagtcatagctcctccatggctcaagtcatcctccctgcctcccaagtagctaggactacaggtgtgagctgctatgtccagctgatttttaaattttttgtagagatttggatcttgatttgttgcccaggctggtgttcacctcttgtcctcaagtgaccttcctgctttggcctcccaaagtgctgggactacaggcgtgagccgtcacacccagctcatgaatgacctttttgaatatccaggaaatctttacagaaaattgcaagggctgtagaaaaataaattatactgataggatttataaattcaaagcaaaaatttattttggaaaagtaaggttaaaagtgggttgttggccacgcacggtggctcacagctgtaatcccagcactttgagaggctgaggctggctgatcacctgagatcaggagttggagaccagcctgaccaacatggagaaaccctgtctctactgaaaatacaaaattggccaggcatggtggcgcatgcctgtaatcccagctacttgggaggctaaggcaggaaaatcgcttcaacccaggaggtgcagaggttgtggtgagccgagatctcgccattgcactccagcctgggcaacaagagcaaaactctgtcccccaaaaaaaaaaaaaaaaaaaaaaaaaagtgggttgctgtgatacacttggtcaggatcctgaagaacatcattattctttagagagcaacaaacatgtatatatgcttagagaaatgcttaataggaaagtcatttgaaacctatttgtattattacaaaaatatttgaactttgtgtcactgaaaaacaagagccttgaatttaaagatagtgattacatccttaaattacaatttaaaaagttcatatgtcaaatgccaattagctgttagcagtttttttttttttttgtcaaagaaaaagcgagagaaacttctaccatctacttgtacaaaatttcttctttatggtgactatcgaatttttagagttcataaaaatatcttaaggataatatgtagttatttcatgtgtaaaactcaatagaattggtaggttaatggaggctagtttacatttgaaaagcttttattttggagttttaaataaatttaatatttaatatactttctaatttttttctttttctaataacaattttcaaacctcttcctctccttaaatgtttctcatctcacatataagcattaaagtatttttatatgagcattaaaaagtatttttttagtctgagatttctacggttctgttcttatttttaaaattattgcaatgtattttctgtacgcttattctctgaactttgacttgttttttttaattttcaaatcttaatttttaaagtttgctagtagtataaagcgagtggttttaaagagtgattttttttgtcattcagcactttactccctgcgggagaaaatgtgactttttgaaggttgagccttcaaaaccttttttaaagtttagtagataactttacttttttagattgtgtcctgtaccacattttttttgagacaggaaccaaattagcttttagagtctaagcaacttatgaagttaagtaaactgtgatatttcccctcatattttttaagaattggtgaaaatattgttgtctatgattattatcaaatgctgtaatttagcagtctgcctaactaatgtagacagactttacatgatttagttcttttgggatatttaaaatttaaatctaaggtagtagaacattagttactgctccccaaaatgtagtagattattttgctgtggcatttaaaatacattagaagtgattaaataaattatggtatatccatacaattggatactgtatgcatttattcttgtgttttgagaagagcatttttgttttgattacatattgactgttttgtattaggttcatttgatccttttggtgtttattttgaaagtaattcattgatgaatatactcagcctaggaaatttgattttggccaagaatggggtcttgatcagtctggtaagctggttaaatgaatgtttcttaagggaatttctactgtaatgtggtctgtacttcaaatattactgtaatatttaggagacgatatttacacacataaaaatatgtgtggcttatggttgaaatgaagattagtcaaaagaaaggatgcctgatagttaaaatgatcaggaaagacttcctggagaagttttaagttgtgataaaagtttttttgttgttgttgttgtttttttttttttgggagggtgcagtgtgagcgtagataatatgtgaggggggaatagggaatagacaagatataagggaaaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaatcttgtagccagtagagcatcatttgaagatttttgagttaggccgtttgaaattgggaaatatgtatttggtcttcaactccatattcggacatacaactcctataattcttagaaactccaaagtgacgtctgtttgagtgctaatgggatgactgttggctggcagcccctaggtaacttcaagatggggctggtcacttgaaagaccaaggcatgattagtgagttgggacttccagccccaccctccaaccactggggctgaaggttaagttgatcaccagtggccaatggtttaatcaatcctgtctatgcactgaagcctctataaaaacccaaaggacagagtttggagagctttcagatagctgaacacgtggaggttctgggagggtggtacgctcgagagggtgtggaacgtctacgtctcttcctacacacctcaccctgtgtgtgtctttatctgtatgctttgcagtattatttataataaaccagctaatgtgtttctctgagttttgtgagccactttagcaaattaattgaactcaaggagggagtatgggaaactcatcttcaagcaggtgagtcagaagttccagagtctggggcttgtgactggtgtctgaagaaggggggcagtcttggggactgagccttcaacctgtggattctgatgttatctccaggtagatagtattggaattgaattacagaacacccagctagtgtccactgcagaattgattgcttttttgttgttgggagaaaccctccacacatttggtcccagaagtcttctgtgttgattgctgtggtggtggtgtgtaagcagaggaaaaaacaattagagcattgtttttaggtatattattctcttgtcctttgtaggagttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttatttggcacacttttttttttttttttttgagacgaagtcttgctttatcacccaggctggaatacagtggcatgatattgcctcactgcaacctctgtctcacaggttcaggcaattctcctgcctcactctcctgagtagctgggattacaggcgcccaccaccacaccctgctaatttttgtattttaatagagatggggtttcaccatgttggtcaggctggtctcgaattcctcacctcaagtgatcctctctcctcggccttggcacactcagttcttgaacttaatttggaggctaaaacattccccaaagatattgtttatttatttgtttattttttgagacagagtctcactctgtctcccaggctggagtgcagtggtgtgatctcggctcactgcaacctccgcctcctaagttcaagcgattctcttgcctcagcctcccaagtagctggtattacaggtgcccaccaccatgcctggctaattttgtatttttagtagagttgggggtttcaccatgttggttaggctggtctcgaactcctgtcctggtcccgtaatccacctgcctcagcctcccaaagtgctgggattataggcatgagccactgctcccagcctaatttctatagttttagtagcgagggtgtttcaccgtgttggtcaggctggtcttgaactcctgacctcaggtgatccacccacctcagcttcccaaagtgctagtgttacaggtgtgagccaccacgtcaggcccccagcagatttttttttttcattttatcttagaaaaaagattcttcagatattagagtccaagaatgtcacagcaattacctgtctgctatttatcagtgagtttgaatatggaataatataaaatgttacattctctttaaagcctgcttatagttaatagcttttcccacatagctaaaaaatgccccactatctcctaagtagcccccacatactgcttgtcagagctcagcttttataatttctaatccttatttatgttgttattttgttagaagaatgtaggccaagtctactgtgacaaaacattaaatcttatatttatttttgaatagtaattaatttgaatggtatgaaacaatgtacaatgaaaacaaatctccttctcatttctgttcatcatgccccagttcccttttttggagacaaccaaaattattcttgtgtagtcttccagagatacgttgtgcctatacaaaatatttcatatgtttttactcctccccattagttttatacagatataccatacttgatacattgttctgtatctttgttcaataagtaatatattttgggaattgtttcctatcactatactaagagcttcctcattctattttttgtagctgcataatattccatagtataaacttagcatatttcaatagtttccagtttgattgatatttaggttatttccagtcttttgctgttagaagcaagattgtagctaatgaccttgattgtgtattatttcacatatattcctgaaggatcaatttcttgaagtggaatttcttttcagaagctctgtgcatttataattttgatagaattgtgaaagtaggggttaaatgaagtgaaactatggaatttggtatattatttacctacgatggaatctcacttcataacaaatgaaattctaagaaagaaatgtataattgctaaaatattagtgaaatctttataaattattttgttttgcaggtatacaaaactaggatatgctggaaatacagaaccacagtttatcatcccttcctgtaagtatttcttttaagccacaaatgagctgatttaaaagatccccttccctaataatttaagtaaaagaagtaatcagttctgaaatcctaaaagatttagtccttttaaaaacatgatttgccaggttctaagtgtggcctcatttttgtatgtctgactattcatttcagctttatgtttagctccccatttgccatgtctactaaatacctctttttaaagaaaaaaagaaattagctgataatgaaacagtaccccaatttttagggtgatattgcagttaacagtatgggggtataactaattatcaagtagtccattccccatcatatacctatgaagactgtcctttggtttgtggatatgactactgtttgtagggcccgtatctgttgacgtcctcactaagtgcccatgtttcaaaatatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctatttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcattatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacacaagaggtcaactgttttgtcatttgtgtagtaagaacaaaattaagtgtgtggcattaaagaaataacactgtctggccgggatcggtggctcacgcctgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctcgaacccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaaacttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttattaagaattcggtgatacatgttggctttattgctgactaatgtagaggtacttctttgggctagtacttgactttagtcgtatttcagtttagtgttagaccatcgtgtatgtacttactggtttctttaagctaccgtacgtaacacagtaccaaaaattgggtggctgaaaacaacaaacacttagaattctggagtccagaagtacaaaatcaatgcgtcagcagggtcatgctcttgctggtgtcttctggcttctgatgtttcctcaggatccttggctgatagatgcgtcactccagtcacatggctgtcttcttaatgtgcgtctttacatcatcatccttctgtatctgtgttcaaattttccctttctatgaggacactagtcatattgtattaggggccaccttgataacttcgttttaactgtgaagaccctatttccaaacacagttacattctgaggtactggcggttaggacttcatatctttttggtgatacacaattcaacctgtaacaatgctgatgacttttaatcttttgtgtataatcttttgttgtgattgtatatttcaggagactactaaagttatttctgccatcttagcaaaattggttttggttatattcgtaaatggctgtgttaactttttgttggaggcctatataatcttgattttttgaaccattggatctcatcactattgaatccattttttatcttatctctctgccaaaatatgaagtctttgccatgactagttgcagtatgttaaaaattcatttgcctgctgtaagaaggtttttgatttttgagtgttttttctcacccacccagttttaatgctgcaggtacagtgtttataattagcagatagagacattgccactgtcttttactaatgagtattgatatttgatctggaaagcctgtgcaagtggttcaaggttttttttatatacatgcatatttatttttaggaaatttatagtgagccacctggatgtctatgtacactgtaagtaaattgctggagagaatttctagcatttagaaggactagatggtggattaaaaatttttttcttccagttattttctgcccactttcttaaggatatagctgttactaaatgaaagtaacagttgaatgccagatcagtttaagtgcattcagacaattattttgaatgaagaactgaacttgatggattcgtacatttataacttaatctaaaaatacataacaagttttagctttcaaactgtatgctggatttctgcaattatttaaggatattgttgtgggtttcacctaaatgaattgagatttccttttatatatgtagtttaacagatctgtattacatttaaattactagaccacaatagtaattactgttactagacccaatcactattactagacccagtagtgatagggtagagatgtaaagaaagtttaaaaaattattcttgaagtttttttctcatttgtgtttttcagtttttttctttccagttgttcatcaagcatatgtggatttggtgggattacagttttactgagaatcaaaggaggatttatataatttaaaaaatatatatttgaaactttcccacagatgttgtttttctggctttttgcatttgaggtcttgtctctgagtggaagttgaggtttcgttgtgtgaaatgaattttgtcactggtttcttatgacttttgtgaattagtttgacaatttaaataggctaggtcatgttttactttgtagtactttgtaatgggagaagtgtaaggtaaaagtttttctcatttgaggaaaatgaattctttgacatgtctaacttattttaaaggtattgctattaaggagtcagcaaaagtgggtgatcaagctcaaaggagggtgatgaaaggtgttgatgacctagacttcttcattggtgatgaagcaatagaaaaacctacatatgcaacaaaggtatgtttttatgatttgtataaataacattttcaaaaaatagtttgttcgatgcttgtgccctctggaattcactctataatagaccttattaatatcctcaaacctcttctcagtagaaatttctttttccctatggcatccttccctgttgctttaacttttttttttcttttttttaataacccctaagaggaaagttttagccctttcaaatgagcagtatttatttttccacacccactggatctcagggccctcaataaaattacctttacttccacattgctacttctgcaaactttttttccccatctttattcaaacttacaccatttttctcttttttgaagtttatgccatctgtaagtgctgttctctttctccctctttttctttttccctttttcttttctacccttttccctccctcttttaattgaggtgtaagtatgtaagtgttaattatacagttcgaagaatttttatgactgtaatcataacaggtaaagaaacagaacaaatctagtaaccctgaagctttccttgtgcttgttcacacagtcactactccattcccaccaaaaaataaatgctattctgacctttatcatcttattttttgacactgactttgtctgatttgcaaatatcctcctttgtacttcttcccttctcataatttattcattaatgaacaactaccatgtgtaaaatactttgccatgtatcgtgagtaaaatggtgtataaaaaaatttccccgactgcaaggctattataatgtggtggaaaggaagacattgaagaaataattacaagtgtgttgggggttagaagaagggaaacacacacacagtgctctgtgcatgtatcacaggagtagctaacctagtgtggggaatcaggaatgtcctcgaggagtaaatctttaagctgaggcttgaagaataaaataggagttagctgctgaggtgggcaggctgagttgttttaggtagagaaaccaatatatgaaaaggctttacagtatgagagggactagaagtgcatgaccaatatgcctgaagcatggagaacgaggtggaaagaagtgaggaggctgtataggtaggcaggaaagagcactgaatatgttgttagaccatgttaaagaatttgaaccctatcctattggcaacattaatgagtatacctagaggaataatttttgcacttaaagtgcaaatattggaatctgcctgtttgaacttgaatcctgtctgtgctaatttctaactttgtgatatcattcagtgacttaacctttctgaattttgatttcttcgtctgtaaaatggagatattattagtacttgaagatttttttcttttctttctttttttttttttttaagacaaagcctcactttgttacccaggatggagttcagtggcatgaacatgactcactgcagccttgaatatcccaggctcaagtgatcctcctacctcagcctcccaagtagcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacatagacaatgaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattattttaaagtaaattgtacatactatttcacttaacaaatacttaactcttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccatttatttatggaaaaaaacttgagatgtcttgtaaaatttcctatattctagggattctgattattacatactcattgggtcatttaacatggtaccctacttcctatatttacttttttttgttgtaaatggtagttaaatgtaagtctgattagatttatgggaggtttttgtttgtttgttttgacaaggaaaaagtggataattaaagagtaacagggcgtgatgaatgggatattggtgataagctagatgtatcaattgagggtaattcccagctccgagatagtcttatttatcccttatctgctgaaattgagaatgttaaaggaaaaacatctaaaaattattttattttatttttaagacaaggtctcaactttgtcacctaggttgcagtgcagtggcacaatcacagctcactcactgcagcctcaaacttctggactcaagagattttcacacttcagtctcctgagtagctggaaccacaggcgtgtgccaccatgcttcgctaatttattttatttttatttttatttttgagatggaatcttgctctgtctcccaggctggagtgcagtggcgtgatctcacctcactgcatcctccacctcctgggttcaggcgattctcctgcttcagcctcctgagtagctgggattacaggcatgtgccaccacgccggactaatttttgtgtttttagtagagatggggtttcaccatttggccagcctggccttgaactcctgacttcaggtgatctgcccaccttggcctcccaaagtgctgggattacaggtgtgagccactgcgtccggccttttattttattttttatagagacagggtctccttctgttgcccatgctcgtctcaaactcctgggctcaagtgaccctcccatgttggcctctctcaaagtgtgggattacaggcatgagccactgtgccaggcttttaaaaaaattttacttgacatataataattgtacatatttatggagtatgtagtgatattttgatatgtacagtgtgtggtgatcaagtcaatgtaagtagcatattcacctcaaacacttatttttttgtgttgagaatattcagaattctctgttctaactatctgaaaatatataataaattaactgtagtcatcatatagtgctatagaacactagaacttattcttgctatccagctgtaattttgtatcctttattcaagctctccctattcccttctttcccctaccctttccagcctctagtaaccacttttctactctctacttacatgaagtcaatttttttagcttttgcacatgaatgagaacatgcaattttttatcttttagtccctggcttatttcacttaatgtcctttgggctcatctgtgttgccaggaatgacaggatttcactctttttttatggttgaatagtattgtgcatatatactacacatatccgtatggacacttaggttaatttcatattttggctattgtgaagagtactgcaataaacatgagggtgcaggtatctttgatatagtaatttattttcctttgggtatatacccaatagtaggatggctggatcatatggtagttctatttgtggttttttgaggagcctctgtactatgctttatagtggctttacctattaacattccctccacagtatatatgagttcccttttctgcacatccttgccagcatttgtgattttttttgtcttttgggtaatagccattctaactatggtgagacggtatttctttctggttttgatttgcattttcctgatgattagtcatgttggacgtttttttcatgtatttgttggccgttgatgtgacttcttttgagaaatgtctatttagattatttgcccttttaaaaaaatcagtgtttttttttttttttcttgctgttgaattgaattccttatatattctggatgttaatcctctgtcagatgtacagtttgcgggcattttgacccattccataacttgtattttccctctgttgatggttttcctcacagaagcattttaatttaatataatcccatttgtctatttttgcttttgttgcctgtgcttctgaggtcttatttgtaaaatcttttcccgtaccaatgttgtgagaggtttcccctaagttttcttctagtacttttatagttttgggtcttagatttaaatctttaattcattttgagttgatttttgtataaggtgagagctagaggtcttgtttcataaggagaaacacttttgactgggtagtgtagagaggagaaaataagtttaattttgaacacattgtgtttgaggtacttgtgagacgtctgagattttgttagagtcaaatatgtggattttggaggtaagaaacaaggcagagctggagacagagattcagaaagtgtcagttaccttagacgggttgacattacctaggggaacatatcacaggggaagagaactaagacagagcagtgtgccagttaggtttgagtagaggaggaaaagtctgcgaaagagactgagaatgcatgggtagatatgtagaggtaaacactgtagaatggtgctgagatgagctagagcccatagataatttgctgtctttcgctacaaggtggtgatttgtaacctgaatgagaatagttttagaagagtagttgggctagatgaaagtaggcttttgagtgataggccaggaaaaaagtaacagtaagagtactgttcattgagtttcaattgtgattgggagggagagagagatgaagagacacatttcaacgttaagatggaagacatgtctgaatgctaatatgaaagaactattagagattaaagtaacaggaaagataaggtataatcaaggtctctgaaaaagctggagggatgagatccagaacacagatgactgaattgacatgcggaatatcttacattataatggaagtaaatgagaaaaaaggctaagtatggaatccattttacagatttgaattcctgactgttggcttctgctgcttctgcgaaatatgtggtggcatcatctgctggtcatggatgtggggagaaggtgaaatcttagcggtaggggcggcattgacactcgtcattgtgaagagtaaagaggaacagagtagaagagtaaaggcttgccaggcaaggttaggtccatttgagaataatgactatgaattcttagtctttagcaccctagtgcaaatgcttctgcggtataatcagcattctggatataggcaagtttatgttagggatatatgctgggttggattttggtagacaggatgaaaaaagaacatgtgaaataaaggtgatgggtcaaaatctagactgtgtatattgatggctagggaataattaaagcaaccagtggaccaaaagtcttaattggtgttcagaagagatctcttgaggtggttgagtatgctagaataataagaggttgtgatcagagaagggtatacctgcatttcagcgattgagaggtgatagtgatgatgatataagatctatactgtggccaaaatggaaaagagataccactgaaagtgatgaagtcagtcagtcgagaggccagagttcctttccactgattctgtccactcattttaaacgcatttttaagtcttctaagtgctactaacaaaccagaacaaaacttctctcaatctttattcctaccttctgtcctcagcaatttagctatttttctctttccttttaaaacgacacttcttagtgagtctcaagatatttgatatgctctttgttaaatccaattatatgtaacagttttcatccttcttgatttgtctttcttttgcaggattactctaatggttatcttcctaacatggaatatttgtttgtttgtttgtttgtttgtttgtttgtttttgagacggagcctggctctgtcgcccaggctagagtgcagtggcgcgatctcagctcactgcagcctcgacttcgggttcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccggcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattatatatactccactcttgtttattccaagatcagacaaaacacaatttttatgttttgattaatggatctggtccatcctaacttcaaagctggaaacctgttggcatcttctgacttttttctctttttttttttttttttgagacaggtgtcttgccctgttgcccatgttggaatgcagtggtgagatcttggctcactgcaagaccctccacaatcactttgaccctctgggctcaagtgattcttccacctcagcctcctgagtagcggggactacaggtgtgtgccaccacacctggctaattaaaaattttttttttttttgtagagacagggtctcactacgttgcctaggctggtctcaaactcctgggctcaagccatcctctcaccttggcctcccaaagtgctgggattataggtatgagccaccatgcccagccctttcttattcttattgactgagaaatcttcaatgtggccccttgtcgtccataccactattggtactcttgttctcacttggttctgttaagcttcatttgagctttcccaatgctgctataatagtcttcctaaaaattaaagctgttcttattcccctgcttaaaaatttctctgctgttttatttcttatagaataaaacctaaataaaaggaaaatttttgagaatctagtccctttgatctagaactggtatatctctctacgcaccttcaaatcttttggcacataaatttctcattgataacttcagttttgtttttgtataccatgcagtgtttgtctttctatacatctttttctgttctccacaagttcctccatacctctcattcccctgccaaaaaaaaagccagaaagcagaactgagttaagacccggcttagatatgacctcctcagcgaaaccttttctctcacaaaacaaggtggtcatcttattcaaggaactatttatttatttatttatttatttatttgacagagtgttactctgttgcccaggctggagtggagtgatgtgatcttggcctactgcaacctctgactcctgggttcaagagattctcctgcctcagcctccccagtagctgggattataggtgcctgccaccatgcctgactgatttttgtattttcagtggagatggggcttcaccatattggccaggctggtcttgaactcctgacctcaaatgatccacccacctcaacctcccaaagtgctgggattacaggcgtgagccatcgtgccaccttttttttttttttttttggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtcggaactttattttttttaaaaacctgtagtgtaatatttgttcgtatatatttcttttgctagactgagttttttgtatgctggatgtctgtgtccttagcatttgtgccagtggcttacagtaggtacacagtaataattgatgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgtttaactttaggtattgaatgtgtattatgttcatggaattatattctgttgcagaggttcacaaactttctcagtgccgttagggtctcagtaacgtttttcactgtgccacctagatcgaaagaaatgtctgatagttctgtttattaaatacctaggtccaggcaacttagtagccacttgaaaaaaataagacacttaaattggaaacgttatttcactgctgagtaatcacatttctgttaggatgcttaggcatcgctcagcttctcaaacctggaatcagatgggacattgccaccctgatttcttgttttatatcgatgttattttatgtgataacttggtttttatgccagcaactgctgacaaaccaacttctgtaagaaataatgtcattgaaaggaatatataatagtttgatttattgttgaaactgaattactgtgacttgtagatcacgcagtgtccaactgatgttgagtaacactatatttccctggaaaatttaaaataactttgcggcgcccttgtgaatttatggtagtacactggggtgctgtctcagttcattttctgttgctataatgaatacttgagactgagtaatttataaagaaaagaggtttattttggcttgtggttctggaggtgaggaagtccaagatgagttggccacatctgatcaacctctggtaaggacctcatgctgcttcataacatgttggggaatggaagaggaaagggacaaaatacaagggacaacttcactttgtaacagcctgccttcaaccctctggagaattaactcagtcctgctgagaactgcattaattcctctaatgacctgatgacctcttaaaggccctaccacctctcgatactataacactgggaattaaattttaacatgagttttggtgggaacacaccacatccaaatcatagtaggtatcttagcacacagttttggaagcatgactcttaaacatttataaaacttttcttataacattttatgtgcttgattcttacaattattctaggtatgtacttacaggtgcactttttatattcggcatacaacaaatacttgttaatggcctaatgcattaaaaattaaggaaattgtgataaagtatagttttttaggcttaatttttgtaggctaacttatccttttattacaaaacttttaaaatctagaaagactagtacaatggtcttccatgtagatttaacagtttttaacattttgacatattcactttgtttttattgaaccatccatctgacaatgcgttattgaactaatttatctttaaatccttaagtacacatcttttaaggatgttctatagtatcacacctatgaatatatcctcatctaatatccactaatgatctgatatttccttttttgtatttttatttgttttttatattaataagatttaatttgtatttccctttttgttttaatagtggccaatccgccatggtatagttgaagattgggacttaatggaaaggtttatggagcaagtgatctttaaatatttaagggcagaacctgaagaccattattttcttttggtaagttacaagttataatttcactgaggaaatttttgaatacacttaatgagaacattttcatcatacttctttggtatactttggttattaaattgtcatatgtctaaatgactttgtaataaagctgtatcatctttaagaccatctagttatggctacaggagaatagtagtatgtcaaagcaccacatgttaaacacttaagaagtgcttttggtagttaatgtctaatctttatgatagaaacagtaagtaatgttcagaaaaatgttggaaacctgtggcacttttttgcttaaaaaacaatagtctgattattatatcattggtatttcttcataacaaaaatacaatataatctaactttttattaaacatctttttattaaagcagtgcatgttcataacttaaaaaatcaaatgactttataagatttaaaacaacaaaataacactttcctttcttacctctcccaacctttggttcatattccccggaggcaaacattttcaattttaacaaagtttgccctgctagtaatcttttaacatgtttcttttatttaacattttttttttatttcttctgtctttaagaatattatacattatttaccaacttcctaataggaaaaatgagaatttccctttttaccttttctctccctcaacacaaaatacctatcctttcccactcctcgcattgtagttacatcacaatttttggttaaatcaatattctgtgtctttcggtgattgtgatggactataaagttgaaagaaccatactatggacactcatacacccacaatctagattcgatgattaaccttaacatttggctataattgcttcatgacgtctatccatctttcacttcattttagtttttaaatcacttcaaagtgagttgcaaatgggagtcatttgacccctaaatactttagcacgtatttcatcaactagagctatcatttgtgtatggttattcttttcatataaaatttacatatcataaaatcaccggtctgcaccattcagtggattttgaccagggtttggcaaactttctaagggagcagatagcaaatatttttggctttgcaggggttatagtccctgaggaaacttaatgagaactttttatacaatggtccctgtcacagctactcagctgtgctgttgtagcatgttagcagccatagacaatacttaaattcataggtatgtctgtgttccaataaattttttttttttaccaaaacaggtggtgggctgtatttgacctgcaggatgcatgatgtgatttgtccaatctttgtcagttacatacatctgtgtaacctaaactcttaccaagatatagagaaattactatcagcgtggaaagttttctcatgcccttttgtaattaatctctgcccccgtgccctagtgacaaccactgtttctttttcatctgagattagctttgcccatgtttgagtgtcaaataatggaatcatgcaatatgtgcattttggtgaaacacttttacttagcataatctggagattgaattatgttgcatatactggtgatttgttgctttttgttgctgggtagtattccattgtataaatttgcctcactttatccattttcctgttgatgaatacctgggctatttttgttttttttttgtttttgtttttgtttttttaagacagggttttgctctgttgctcaggctggaatgcagtggatcaatcatggctcattgcagtgttgacctcccagctcaaacagttctcccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattgcagcgtcatagggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctggctaacttttgtaattttagtagagacaggattttgccatgttggccaggctggtcttgaacttctagtctcaagtaatctgcccacctcggcctcccaaagtgctgggattatagatgtgagccactgcgctgctagcttgtcagtctttaaaattttagccgttctggtgggtgtgtacgatttttcatttgcttttaattttaattttcattttctgataattatgttgagcagtctttcatgtacgattgttattattagctatttgtatattttcctttgtggggtcctctgattatcttttatgtagattttttttcttggagtttataatttcactgccttggtttttagtttacttaattttgtatgtattcatcagtaaattatctccagacttttaaacatagctccagaactcttctaaagaagtttaaacaccacagggagtttagcttataaaggttttatgtaaggtaacagtatacttagttgttttgctttatatttcttttgaaataataattttaaaaatatttaatttttaatggattcaagttttatcactttttccctttgtgatttgtacttcagaaatttaaggagttattcctaccttaaggtcaaaaagagaattctgtgtcttttttaaatttaaaaatttttcttttacatttaagtatttgagatacctattagattgccagtcagactcacaagaatcagaggtcttacccagtgttaatctttaaaaattgaaacagtttaagtgatcatgaggcataggtgaaatatgaagtccaagactgccagatctctgagtccttccttgcctctttagagtgtgttctgtcccagacttaacctgtgaggtttctaagtgatgtatacagtcacataaacagaagagtgctctgcaaacatcttgattctatgctcttaacaggtaaattaatataacatttttcagaaagctgtaccattagatctgtagaatctcggcttgtttactgtaatcctatatacttcggggacattcatctaaaagcattacttagatgagggctctcccactggcaaataccattgatgttttttctggaggtttgtcattaccatatttaaaggatgatttgactggaccaccttttccctacctccaaccctctctctccctgcttcatttctttttaatgtttaatctgtataagtggtatgatataggcattcagggtattttttttttaaaatgtgaattaccatactgttttcatatatgtatggatgtttgaattctctatagttttcctttgatctctgtgtctgtctttctacttgtaaatttaatgcattttaaataaaatgtttgaaataaattacttctcatttaaaaattgtcaagaaagttatcaaaataatctgatattatctatttaaaatgttatttatttcaatagactgaacctccattgaatactccagaaaacagggaatatactgctgaaataatgtttgagtccttcaatgttccaggcttgtacattgctgtgcaggtaagcaagttcatactttctaagtttgattcttacattttaacctagtttaatttgctgcctaaaatacgtactttttttttttttctgcaaaggtttaaacataatgtcaaagcatgttatacttctctcctgaattgttaatttagaagtaatattatgggaagtggagatatttagtcaggaaaagagaagtgttaaaaaagtaagttagtggtgtttgggtatttcaagggctttcataggacagaaatgaaggaactaatatttatggaatgctttctctgtgacaagaacattgtatatatatttatccttgtaaataatcctttatcatttatccttataaatctttttgtcctttattgtagtcttttttgattgacttatctttaggtatatttgacaccctaatatttcacttctcttaatttgtacgtttatctgtatggaacagcttctctcccacccctcaggatcagagctgacctcattttttttttttttcccttgtagcagaggtaatccctgacataacacaaatgctttatatgtgtattaattcattatttctattaaatgtagatatttttgtttctgttttttgtggaggaagaaaactaaagctggaaggcactttattcataattaaatggttagctgtgataccaggcagctgaggtctgtctgactttgctctttcttgggatcacactggtttttgtaactccacggtacacagaatcaataagtgataattatggatgaatattttaacttggatagcaaagaactttttaatgtttaatgcaatccataaatttaatgaactgccttttaaattctctgctgctaaaaatatttaaggagtcacttaaacctgtcatgaactttatagaagaattcagtcttgagtgggaggcccttttttagttcttagaatatgaataaaatgaggagttgggaaaattcatctttcacttgggagtttttgcttctcatcctatgttaaatataataaacttatgtttaaccatattgtcaggtaaagcttactttaaaacactggcatcatgagctttgtttcattcctctggagtcgtaatttggtttttcagtgatttccttagtggcctctgagtgctcttaatttcattatttaatctctgttctgttttgttgatgttcagtagtcaataacatttctgtaacatgatgtgctgatacatatctattctagtttgggaccgtaactgtttacaaaagacttgtaaaagtgatcagagataattcttggttgtagatgatagttttgaacttacttatagaggaaggatatctcataatgaagtctaaacagtatatatatatataactagtattaggatggaatttttcattttaagattgtcaaaaaataatgtatagttctgttagcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcatagaaaaattttatcaacgttgctccataattaaatcatagtagtatttggaggtgtgcgatggcgttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgggcacctgtaatcccagctactccggaggctgaggcagagaattgcttgaacccaagaggcggagattgcggtgagccgagatcgtgccactgcattccagcctgggtgacagaaagaaactctgtctcaaagaaaaaaagaaaaagaaggtaatcttttagtaatagttgtttatagccatatatgtattgaataactggaggtagggtggttgtgtactttctgccttacattgcagtttgtaacaggccagcccacgtggacatagtttaagttctggcaagttagttctatacaattttttttttttttttttttgagatggagtcttgctctgtcgctcagtctggagtacagtggcatgatctcggctcattgcaagctccgcctcccgggttcacgccattctcctgcctcagcctcctgagtagctgggactacaggcgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcaaaatgactactagaattcatactgtttattattaaatgggtatatagagaaaggtttatcttttaaagtaatttttatattataatgaatatcacttaaggatttacattattttgaacttttttttttttttattctcactccagtgtttaatgcatcaggcaatgtctgttaaagattacatcctcagggtgactacctttggattagactcctggtcctccaccactttcaccctcatgatatgtcataatggttttagtaataactgccattgtttaacgatagcttaagataaaattcatataccatacaattcacttctttagagtgtacagttcattgatttttagtatattcacaaagtccatccgtccccacaattttagaacattttcatcaccctacaaaggaaccctgtaactattaacagtcaccacccatttccccttgattccttcagcccctggcaaccacgaatctactttttgtctgtgttagatttgcctgtcctggccattttatgtaaatggagttaaacactgtggtcttttgtaactgggtgctttcacttagccgaacattttcaagattcatccatgttttagcacgtatagtatttcatttctttttattgccaaataatatttcattatgtggatatatgagattttatgtagcctttgggaggattttagtaagcttggaaattaggacgtgtccagcatttgatagctttttttagtttacttggcagtttatttttctttcttagtggtacataaaataatttttcatcttaaaattattgtttaaatctgaaaatcagtctgtgataaatattatatttttctttgagtacctcagtttactcattaataaaatgcaaataattgacttgcctaaggtcaccaaataataggtagtgaggctaggatttgacctggttctgcctttcttcagtcttttcttaacagctgcacatctgagcagtactatcagcatgttgataattagaataggtaatttgcagaatagaagttatcaatatgtaaaagaatgagttttagtaaggacattaagagtgggtattctggctggtatggtggctcatgcctgtaatcccagcactttgggaggccaaggtgggcagactgcttgagcctaggagttcaagaccaacagggcaacatgctgaaaccctgtctctacaaaaaatgcaaaaattaattgaacgtggtggttcatgactgtagtcccagctactccagaggctgaggagggaagataacctgaccctggagaggttgaggctgcagtgagccatgatctcaccactgcactctagcttctctagcttgagcaacagagtgagaccctgtctccaaaaaaaaaaaaaaaaaaaaaaggttggtgggggggtgctattcctttttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgtttcattttgagtggtgtattagtttgctagaactaccgtaataaagtactacagactgggtacctaaagaataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacaccacttatattggattagagaaagcaaccctaatgaattcattttaactagataccactttgaataccctatctccaaaaaacagtcacgttctgagatagagcttaggacttcagcatgggaatttggtggggaggaaaaacacaatttacccagtagcaaaaagttatctttaaaagataacttttttggagacagagtcttgctctgtcgccgaggctggagtgcagtggtgcgatctcagctcgcttcaacctctgcctcctgggtttaagcgattcttgtgtctcagcctcccgagtagctgggattacagatgtgcaccaccacacccagctaatttttttgtatttttagtagagacggggtttcaccatgttgctcaggctggtcttgaactcctgccctcaagtgatccacctgccttggcctcccaaagtcctgggattacaggcatgagccactgtgcccagccttgaaattgagttcttttattcacgtaccatatctagtgctctctattcctttgtgaaggtccagatttccacctagtatcattttccttctgtcaaaatgacatccttcaacatttcttatagtgctgatctgctggctttgaattctttcaacttttgtacatcctttgaaaaagtctttattctcctttagttttgaaagatgatttttgcttggtatagaaggttgacagttttcccctgtagatgtcactccactgtcttctggcttaccttgtttctgaaaataagtcagctgttattcttgtgtgtgtttctttgaatgtaatgtttatttgggtggctgtcttcaagattttctttttattcctgattcattggtttttagcaatttgattgtgatgtacctaagtaaagttttctttatgtctcttctccttggggttcattgagcttcttgtatatatagtttgtaattttcatcatatttggaaagtttttgtctgttactgattacatattttttctcttcctcttttctctcctttaggtactctaatcacatgtatattaggctgcttcacagtgtctcaaagatcatgatgctctgtacatttatttttttataatctttttcttttttttggatagtttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtcattcctctgtattgtttggtttttctcctcgttaagtgttgtgtttttccgcttccttgcatgcttataatttttgatttggcactctatacattgttgtgtattgtatttttggagttctttataagtatttaggattttttcctgggacatagttaagataccaggaactagtttgatcctctcaggggctccttttaaatgttattaagcaggtccgtaacaggtttttgtccagggctggtttgtccccattcttgaggcaatattcttctgaggactctacttcatgtcttgtgtttgaaaacatctttcaactttggctagtgggatcaggaactatttctggctatgtgtgagctctggtggtggttctgtctacttttttctagaggtcctttctctcaccttgatggtttcctcacaggagtgtgctgatcagtattcagttaaggaggtactctcttcacatcttcccagctccctgttggttcaactcctccccctccaataatttggcctacaaacttcagccactttggcctttctgacctttaaattctatatccctaacttaatgagaccagtttgagttctctttcctattgttgtggcctagtaactctccctaggcagtaggatagagtgtaacattcacgttatttgtttcccttttcttagaaagtatctctgccctactctgccgattgtcaaatgtctgaaaacctttctttctttcttttttttttttgagacggagtttcgctctgtcgcccaggctggagtgcagtggtgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgaaaacctttatttcttataaattgtcctgttttctctttaaattgagagggtaagttcaatccctaatattctgtcatgccagatgaaggcatccttaatattctttcctaatgaaatttaattttgccacactatttgttatacttctgacacatcagtaaatttgtgaatcagttctacagaatttagttatttggcattatgatggtgtgtggaaagcttcaggtttgtgaaatggatacatacttgattaggaaaatgataagcactttgtcacatttcttatgaagcaatctaaattttttactgaaattataaatgatttaaaaatagtaccatctgatataaagtctgctatctaaaccatttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtatcttttttcccctctctaggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgatagggcacatagaagaaaaacatgaaggctatctaaagtattttattaatttttttctgccatgtaagtattatatcagtgcttcatgcaaactatcaaaatactttagcatcgtctttcaaacttattatttgccacataaccaaaaaatttcagtgggtttcacgtgttttgaaaagcagaactgccatggcaaaagtaacttacttgtctctgtttccatggtttttttttttttaattacctgtaaatttttaaaatttttaatttcttatttttattgatttttttttttttttgtagagatgggatcttgttctgctacccaagctggagcgcagtggcacactcgtggctcactgcagcctcaaactcctgggctcacgtgatcctcccgcgtcagcctcctgagtagctaggactgcagatgcatatcaccatgtctggctaagtttttgtagagatggaggtcttgctatgttgcccaggctggtcttgaactcctggccttaagcaatcctcctgcttcggaatctcaaagtgctggatgtgagtcaccatgcctgggcctctttgcttgtttatgggattttccttgctcgtcagagcttaagaatgaaaatttatcaactacttcctaggtagtaaattagtaaatgactaccaaaagttaccccaagttggtggcataagaattaaatatataaaaagttaatgtgaatactactgattcaacatctttgggaaatctgtgaaattaaagcaaaacgagaaaacaccagagatttaaatctattccagagaagattgatggtcattctgaatgtctttaaaggaatatcatttctttgtcattctcacttccaaggtttggagaagacctcaaatagtgtaatcaaatgtcttcggattccagtattttttctctttgtgtattttgattattactggtaatatttgcatctatcttggatggtgcctgtgatgtgtaaaaatactggaaaaggaagtttttttaaaaaaataaaacaaatattggttggcagttgggagtttataaattacaaatatgatgttataatctataatatatttttcagtgtttttgatgaaaacttttacttaggtcatataaccaaatatgcaacaaaatagagtaatttatatttttagccttttttctttgctcttttatttactcagaccgtaatcagttttgtttcagatagatattaaggatctatattaatttgtgtggttatcacaattattacttattcttcagttctgtattttatttattctccttacctacagcacaagattcattattactgagacagaaaatgttgaatgacattagtgaacattttcaggaaataacattgaaatagtagaagtcagctctccagtctctcaaatactgtttatatttaaagtcagaaaatatgtgtaggagatgagtatgtttatttgtactacacatatgataatatcctaacaaatttttcttccagcttaatttcctaattttattttctgaagagttttttttttttattggattatagtttactgaaaacatgccattcttctttactgttcctataataagcaaaaaaagttacttttgtttctttgtttttcaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagaggtaattttttttaacggaattgtttaaaagtattcagcagcaaatatgaattaatagatattcagagagaattaatctcagaaacttttattagtacactaaaagtttgagtttttatgaaaagtttataaaacattttatgaactttttaaagaaaaaatttgcttttgttaaaataagcaaaattgttgctattttttgcagatttagaaaaaactttttaaaaaatatgtgtggcttatgggggggtcatgaaaagaggagagcccttaaattttttttttcttccctccatcatggactcaggtaaagttttgtaattgaaataaaatattttgggaaaggttctagaaagctccccccctccctatttgtgtaaaatgaccattatacaaagaaccttcaattaaccattaaaatatataactagtagcaaaatagtcttctgtctatgaagttttagcaacataaaggctttattaaattaagaaatacatacttttaataatggaaaattcttctggtaacttagtatcagaattgtaactttattaatagaattactaatattacgtacttactctgcttatttaatgttaagaatagttatttttaaaattttgtttattcactcagcaaatgttaaatggtttgaattttcatgatctcagcttaagcactgggtattcaaagatgaaaaattattttatcttgctcttactgagctcaaagaataaaagagatgagtatttaaacacgtaaggttatagttgctttaatgagtgtatgtatctgctgagggcacaggaacaaagagcatgtaagtctgcttgggagaacatctcaggggagataatggttgaactgagacttaaaggatgaatgggtgtttgtcagtcatgtgtggtaggggagtatatgtatttttgtcagaaggttagctaggcagaggtcttagacatgagagtgctggaaagaaaagtatagaggacagattggtaggagagggatccagataggtattcatggacccagtcttgaagggcagatatgttatgcaagggagttagctagattctgtagtcatgcaaaaattttaagcatagaagataattgtgtaccatattagaaaggttactctcgcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggaggaaaaggttttgataaagcagagattaaagtattacagcatagaggagagagcaagtcctgaaagctgaattacctagggatagtgagggtacaggtattggagatcatgatgaaatgacacataataattgtgaattggtagcagaggagtgagcatgagaaggataaggaattgtggtcagactagtatactggagtgtgaaggtttttggtggtacattttctttgcactttatcaaaacataaagattaagaggatgtatacacacaattttaaaggtcaaataacactgacagacttaaaattagcagctcttcaccctcctgctgccattgtgttctatagagcatccactagcttttagttattgctcttggtagtaacccccagatttctaaatactgtgatggtattgcaggaacatggatggagctgtttcttgatatgtcactgttagtggtttaaatgctagcctcctttcagattagttctttctagactctcttttcttccagcctgccaacatgttaggttattgttattaggtaaatcaatagtattgtaatatttatagtattatacctgagactgttgttcacttttgaggcaagtagtgtaatgtgattcttttcccttaaaattcagcttttcctacactttcaccttgtttattcatttgcttcattttctttttttttaactttaagttcaggggtacatgtacaggtttttatataggtaaacttttgtcatggaggttgtacagattgttttgtccccaggtattattaagtctagtatccgttagctatgtttcctgatcctctccctcttcccactctccaccctccgataggccccagtgtctgttgtttccctccgtatgtacatgtttacttatcatttagcttccacttaaaagtgagaacatgcagtaattggttttctgttcttgcactggtttgctgaggataatggcccccagctccatgcatgttcctgcaaagaacatgacctcattcttttttatagctgcatagtattccatggtgtatatgtaccacattttctttatccagtctaccattgatgggcatttaggttgattccatgtctttatttttgtgaagtgctgcagtgaacatacatatgcatgtgcctttatgatagaacaatttatactcctttgggtatgtgggattgctgggttgaatatttatgttttaggttcttgaggaattgccacactgttttccacaatggttgaactaatttacacctaatatacaccaagagagtataagcgtttctttttctttccagctttgccagcacctttttttttctttttaaattgtatttattttttaaaaatattttctctttccttcattttttaggagggatggtgtgagaatattttttgagtttttaataatagccattctgactggtatgagatggtatctcattgtgggtttgatttacatttctctaatgatcagtgacgttgagctttttttcttaagatttttggccacatatatgtcttcttttgaaaattgttcatgtcctttgcccactttttaatggagttgttttttccttgtatatttatttaagttccttatagatgctggatattagacctttgtcagatgtgtaatttgcaaagattttctcccattctgtaggttgtctgtttactctgctgatagtttcttttgctgtgcagaagctctttaattagatcccatttgtcattttttgcttttgccatcttcatcatggaatctttgcccatacccgtgtccagaatggtataatttgcttcattttgtttgtacagtcatttattcattcatttatttattggggtttgaattaactttcttgttatacacggtctggaagggaaccgaggagggtgggtctcattctatatagaggattttaacagtttcttttccaaacaggattgaaatattgtattcattgtttttttgccccctgattcatccttggtcatttacctttccttttaattctcttgctgtcattttagcggagagtcaagagacgggagagataaccacatgtagctggaagttaggacagatttttgtatgggccatttatatgtgagtagattaatagaagtgtgtcagacctcatttcatttaaggcacatcaattaacttgaaattgaaatcttagagaagaatattaaagctccaagttggggacaggaattagaaaattgcagaagatcctgagcaaatgtcctgcatgaataggatcatgaccacacgatggataatagcatgggatataggagatgagcatttgaatggaatatgcttgacaaatgagcttagctgatgccttggctttcttaaaaaccttgaagtaggctggttgtggtggctcacacctgtaatcccagcactttgggaagccaaggtgggcgaatcactcaagcccaggagtttaagaccagcttgggcaacatgggaagagcccgtctctaccaaaaaaatacaaaaaattagccaggcatgtggcgtgtgcctgtagttccagctacttgggaggctgaggtgagagtattgcttgagcccaggaggtccaggctgcaacgagctggcattgcaccattgtactccagtgtgagcaacagagcaagaccctgtctcataaataaataacccaaagctttagatatgtaaataaaatgtgtttcatattgcttaggaaaggtatagttggctggatgaaaatgtgtcttgctgctaatgtttcatatatcattttttctattaatttgaataacctttattgtttcatacaccaatttttctttattttttaactttaaaacattttctgttgtctatagctttatgttccttataagtaatttcttctatgagaaacctgtttctctttttaaaaaacctgttttgttttcttttttttaaaggctgtttttaaaaatcagttatatatatgcacatggtttaaaagtcttggtctgcgtatcctaacaaaaactaggggtgccctgcatgtttctttctcttgttttgtatttctagaggtaaccacttcaaactcttcttagttgcttcttttgctgattacctccttagctatgaattgcttggttatattgcaacttcaaattttttttcagtgttaggcttttcttgttttcttttggaaacagggtcttgctctgtcacccagtgcagtggctgagtcatggctcgctgcagtctccccaggctcaggtgatcctctcacctcagactcccaagtagctgggactacaggtatgtgccaccacttccagctaatttttgtatttttcgtagaaacagggttttgccatgttgcccaggctggtcttgaactcctgggctcgagcaattcacccatcttgccctcccaaagcgctgggattataggaatgagccactgtgcccagccctgtgttaggcgttgtctgtcgaattccaactatggaagaggaagattgtcttttttatccttcttctgtcatcacagacaggacctttctattcccttttcatctcatttgttacattataatttcaagtaggttgaaattcagtgcttatgtttttgtgaccacaaattttgttcatatctgagccatgtagttaaccatgaaatcttttcccttcctataagtaactttgttttccaagaagtcattaataaactgtttgcttagtgctaaaataattaccattcattcacctccaaactctcttcagtagttatataaatctcttctcaggatattcagatgtatagggtttattcatcagtttaattttctgaagtgtcttttacatcccaatctgaacttgcttctgtcggttcccagtatagagttgccatattcctttactatcattctagggattccctttccctctctcttgtgttggatctctttttcgtatatcctatgtctttttcactccatttacatgatctaaatgaaaagattttgtattagtatgtgtcactttgataacattaaatctcttttcattgtatgcgcagcctgtaaataatttagaactaatcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctcaaaaaaaaaaaaaaaagaaaaaaaaaaagaaaaaattgacacatgcctaataattatcaatacagttatagactcagtttaataaataaaggaataatgtctctcaactaggacaacctaatgataaaaatgaatggctgaggagatatacaatacttgtttgtttttcactaattagagctagattttgattatttatttagagacagagtctctctctgtcacccaggctggagtgcagtggtgtgatcataactcagtgtaacctcgaattcctagggtcaagcaatcctttttcctcagccctctcaagtagctggaactacaggtgtgtgccaccatgcctagctagtttttaaattttttgtagagacagggtctcgctatgttgcccaggctggtgtcaaactctgggtctcaagcaatggtcctgccttggcctcccaaagcactgggattataggtgtgagtcaccatgcccagcttcaagttgttttttgtttttgtttaagttagttttttaaaaagtatgtttttcttgagtgccagctgtttggaaatagtaagtttattttgactatggtatatcatcgtttgaatatatagctgatgtttgttattcaaagtagatgtgccaaaaagttcttgagagcgctgaattagtgaacactgagctagctattgctcctaggggaaatacagtattaggtttctttgagcctctggtaacatttttgttatcccattaacatatacccttgtttcatgtgtgtttctttttaaaggcactgcatttagtatatcattttagtatattcatttatattcaatagcactagaacacatgtctgaacaaagctatctaacttgctttttctctgtaagacacatcacagcctccttgtgtttactagccagcacttgagcagtatgcttgggggccattttaaataatgaaatcactaacaaaaatatgaaaaccgtgccactaaatagaactgtgaaaaggacacttgtttatagtatgagagctgaaactagatagcagagtatcatcttgttcaacctcaatggggaatgtgcacatcagtggactcaaatttttgttgctctacacgtgcatgtccatgaataaccatattttgatttggggagtaacaaatatgttttagcgattaggtaaattcacaaatatggaatcatgaataatgagattagactacatttatttatttcatcccctattgatggacttaacgggtttttcctcttagaaacaaggctatagtaaatatgcatatgtaatagcatacatgtttggggagtttcttcagagtttgttgtaagaagtggagttactggtatgtgcatttaaaattttattagctatttgtattagtccgttttcatactgctaataaagacatacctgagactgggcaatttataaaagaaagaggtttaattggacttatggttccacgtggctggggaagcctcacaatcatggcagaaggcaaggaggagcaagtcctgtcttacatgatggcagcaggcaaagagagaatgaggaagacgcaaaagcagaaatccctgataaaaccatcagaccttgtgcaacttattcactccatgagaacagtatgggggaaaccaccctcatgattcaattctctctcaccaggtccctcccacaacacgtggaaattatgggagtacaattcaagatgagatttgggtggggacacagagccagaccatgtcactatgttactattgccaaattattctccatagtggttacatcagtgtatactctcacagcgttatatgaaagtttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccactagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttaaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtggtttaataaagtaacctttgtattacatgtcctggacctttaggcttgaggttaaaaaaaatcaaaattaatttaaaattcttagatgtctactttctatatttagagatagattcttcatttttttcatccttgttaaatattgaagcagaacgttgatttagaggaatgatatggcttttttcaaagctgtttgaaaaaaggtatttcatgtgaataaaataccttctgcttggaagattaccaagaatgaggactttatctgagacttccataatcattcagaattacttaaaagtaaagcacagcactctagggtttgctgattgttgagaaattgcatgatggctgactgttgtcagtgcctatattttgattatcttgagtaaacctatccctaggaatgcagtaaaaagtatatgttttgggtggaaggcaaaatattgaactctgtccctataatgtcatgacttcacacttcaggaagtctactcaatagacttttaaaatgttgtgtttgcttttgcatccccttcccaaccaaccaaaccaccagcccacccccattcatccattcatttgcccatccgtctactccccttacccacatatctatctaccctacctcctacctaaaaaagaagtcattgggttttgcaagtataaattctctgtactgagaatcctactaaccacattgattatgtgaatgaacatagtgcatgttctggtttttttgttagaatacttaaaagattgaagttgattgtcctaatggtatggttatggatgtattaaagtagctgtttagtttttaataactcattacagatatataagtacaaaacaatgctgtatgtttctgagtatagtattttaaaaaagtgagattgtttaacatttttaagctctttttacacttgtaaataagaaataaatttacccagtgatcagtaccgtatcgacatattgaaagaaacagattgggtgtcccttttttgaattgcttcataccagaagtgttgcaggttttgagtttttctggattttggagtatttgcattatatactggttcaacatccttaatccaaaaatctgaaattctgagcatttcctttgaacatcatgttggtgctcaaaaagtttttggatcttggagcattttggattttcagacttgggatgctcatcatgtataggaaaaaccttgtgttttggaggactctgccttcttcaccttagttttacttgctagtaacttttatagatcttaatagcatgcctttatctatctatctctggctttattttccttcagtctgtaatttttaatggcaaccaaacagttttgaaaaaagccatatcattctgtttctataaataggtgtgtgtacacacacacacacactaaattgtagatatgatggttcattatccccaaacattttagtatatttctaaaatcaagaacatattacaattatcaaaatcatgaaattaaccttgatccagtgttatctagttatagaactgattctaattttaccggttgtttcactaatgtcccttataacaaaaggaaaacaaaataccttcttcccccttatccaggatccaatcaaggattgcatgtttcatttacttattgtgttgcttcagtctgttacatactcaatgttttttgtctttcatgaatgaatgtgacatttttgaagagtacagccatttattttgtagcatatccttcagcttgggtttgtttaatatttctgcttgagtaggttcagattatgtacttttggcagtgatgccacagaattgatattgtatcatttttagtgcattgtatcagtagacacatgatagaatttgtcctgtgtgtgaattttgagcttttggttgaagttgtgtctgccaggttttttcactataaagttattatgttttcctttatatttaataagaatctaatgaggagacactttcagactatcctgtttctcttttaagtttcagtcactagtttttagcatccattgtgattcttccctaaaacagttattactgtggtagttgctaaatggagttttgcaatttctgtcattccttctatgtttttaagacttgttttactataagcaagagttttcccttctcccacattcatttattcttttagtaatatctatatgaactcctgatttctcattttgtggtctatatctttaatatcactgtaatatcataatatcagtaataccactcatcattaattttaatcccacatttttttttttttcagatttgaccagtgggagttattcaaatggctcttaggtttttttttttgatgcagccacatctttttttttgcctacttctgtacttcccggcacagcaaggtgtttcaggctgatcttgtactttctcttttctggccctggaatcagccctttttttctccttttctttcttcaagacacccttgtcttattcctgttagtggagaacgttactaagaaaccaagctttgtgctcattgctgttggggtatcactgagtctaggccttctcagtgattagagctaggggtgtgtgtgtgtttatacatctatatctaattctctacataaattaaaaccatgaatttttacagacgtctccagttatagaaggttcactctagttttctgcccttccatattgtaatgcccttctctgacagtgagaaacctggctcctattatctataatatgtttatgtttttgcttaatcctggaatatgtatatgatagtttcagaattgttaatccacaccactgtgaaaaatagacccaaaactagaattcaatatttgcttatattttatcttcagcctgaaggcttataagattcaaaatactatgctcacaagttgcttgtgttagtccctttcctcaccttagtgtgcttatgtttgaaaaaagtacaattagtttaatttgtttttgttgtactttgttttgccccaacctccccttcttttaaggtgttattttttagtatgtaaaacactaacatttagattcttaaagtcagaactgtataaaacatgtgctcattgttatttcccttccatttattctgctctgttccctccctgtctcttccacagtgttcccaacccctttcctctgagacagccaatctcaattgtttctggtttgtaagataccacctgaatttagtacagatattatttttgtatatgtacatttaaggttaaatgacacagaagttgttatttgaatttactatgaagatgatcatactatgtctttctttagccaaaacctattgatgtacaagtcattacacaccacatgcagcgatatgcagtttggtttggaggatcaatgctggcttccacggtgagtgtgatgaagcttacttttattttattttatcattattattttatttatttttgaggtggactttcgctcttgtcacccaggctggagtgcaatggcatgatcttggctcactgcaacctccacctcctgggttaaagtgattctcctgcctcagcctcccaagtagctgggactacaggcatgcgtcaccacacctggctaattttgcatttttagcagagactgggtttcatcatgttggctaggttactcttgaactcctgaccttgggatctgcccaccttggcctcccaaagcaaagtgttgggtttacaggtgtgagccactgctcctggcctttattattattattattttttattgagatgaggtcttactatgttgggccaggctggtctcaaactcttgggctcaagtgatccttccacctcagcctcccaaagagcgctgagtttacaggtgtgagctgctgcgcctggctgaagcttatgtttaaatttatatatatatatttaagatagaagagtccatcaatacttggagaagaacaaagcaaattcctttaaattgtatctcaaaataataggaaactttgtatatatgtgtttgtagtattttaaaaattggaagtaatttaaatttaattggaagtcatttgaatttaattttttttttttttttagcttgctagacattattttagagtgaccattttatactatgttttaaagtttatctgtagggaaagttctgttaaaactggtaatttagtcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattac

SEQ ID NO: 54 - DNA, 45685 bp, homo sapiens
gtagtccccgcctcttccccaggggccgcgtcggagcctcggcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcaggtaagcggcgcccgactccagccccgaactccggtccctggctctgccctgcccgctggccgcctcaggcctctctggccggcccgcggccaactcgacgccggggcttggcaggccgcgctgggcctggaggggcgggtcgggccccgggctcggattcgaggctgccacgggcccggcctgcccgtctgcgaccccaggtgggactccggcggtggaaagtcctcctcccggcctcgtttcccgcatttcccagggcgggcgggtccctgagtcagaacccgcgacccacaggcggcatcgatctgaggcattcgtttttcatttttccacctttggtttgatgtcattggaaaagaaagaaagaaaaaagcatgaaacggaaactgggtggagagaaaagattaaaatctctgctgctgccgatagctccccacagcaagatgctattgctcagggtttcagagcctagtttgtcgaaacccatccccctcgcctccgttttaagacaaaagtaaaaaatgaagcaagagacaagcccgcagtttgcagtagatttggaagaggcgatgtttggctgtggtgatgccccaaaagggagagctacgatgaagtctgcagggcgtgtgccgggtgtattttaaatgcttggaagtgacgttttaagagatttgatggcatagctggggaggaaatgtataggaaatgattggatcattttctcgggtttgatttaatacattgaggccccagggaaaagagctgcttgtttcactccgcgtctgtagctaagttcccccaggaaatttagagaccttctgcagggtttttggaagtgttaatctaacatacagtaatggtgggaattgagccaggtggtaaactgatgttgattggaaccgcaaataacggcttgtgtttgtcatgtttcagatgctttcggtgcatacagatgtcaatcctccttttatcaaataaaatgtcctatcttagacgatctacaattttatattttagaagtaaggaaagccagccagtacgatgaaaacgtagattaaccctggtgcggccggccggttactggtttgttttgctatcatcagccatgtgttgcaatccgtccccactcaggcttggactcccaaaatgactagttaagaatttcacttcttggttttataaacacggcccaaattgtggcaatgcagttaatccttagatctcttcagagcacatggatctagcacatgctttttttctatgaccttgggcagcctgcgggttccttactgctttaataaaatgggaataacagatgccacttaactgtcaccacagtgtttgcaaatcacccctactgtatactgtcatctgatttcatccttttcatcctgacttggataaggctaacgagcaaaagagctgtggtttttctttgtactgccatcttcttgagctattaggtaatgctgacatactgctagaatataaaaaatttgctggagtatcaaaatcatgtattccttagtgtggcatttaatattttttaattatgcagaattgaagtataaaaaaaagagaaaaaaatcttcctagaaaaattgtaaaagatgaaagcccaaaaaactgcaaaaccctccctaaacaaaaaccaaatagataaccaaaggtaatattttaatgtgcattcttgtgggtttatagctatgtaaatatacatagttatagatcagtatatgtgtgtacagataaggaatgcaggaaagctaatattgatttttttatgcaacaatcacagtattaagtaatttacatccattttttttttcttttaattcataccaaacccttatgaaccagggtttgttctcattgtcaaagactcaaagtggctcagtaacttgcctcaaggtcacaggctgctaagtagtgattataaggatatacacacactcacctacttaaaacacaggctcacagtccagatataggtgtatgcattagcagatatatacacatgcatatgtattctcttatgtacccatatatacgtatacagacatatctttgtacatttgtgtgcagttttatgagccccgatcatacttgcacatacttttgcacgtgtccatgtgtatcttgttctcagacatgtgcattcatacatttgcacatgtgtatcatgcacatgtatctacaaaggcatgctagataaataatgaaataggttcataattctattttgtaatgttcttcacacaatgttattaatgtcttctatataaaatatttttaatgtctgcatggcatgtaattgtatggctgaatcataatttaactaattgcttatctttggtcactaagaatgtttacagtttttttcattgaaatttatttcacatacgtcttcaaccgtttccttagcataaattactagccatggaaatgcctggtcagcgaatatgcatttttaaaaggcttttgaattatagaatgatggtgaattgtccaggcaacttgataggagcatgatactctttggttgtcacacagggctgttctgacttctatttgatctggttaatcaaattgagctagttttctcaccaagtaaatgtaatggaaaactgtatgattcattcataaatgcaaacacagttttgtctttatggtctttttattggtagtgtaatatgtggacaacttgaatttagcatagtgacagactatgcagaaagggtaggctcaaccaggtgtggtggctcacacctgtaatcacagcactttgggaggccgaggtgggcggatcacttgaggtcaggagttcgagaccagcctggccaacatggcaaaaccttgcctctactaaaaatacaaaaattagccaggtgtggtggcactcacctgtaatcccagctacttgggaggctgaggcaggagaattgcttgaacctgggaggcagaagttgcagtgagccaagattgtgccactgaaccccagcctgggtgacagagtgggactgtctcaaaaaaaaccaaaacaaaacaaaacaaaaaatggccaggcaaggtggctcatgcctgtaatcccagcactttgggaggccaaggcaggcagatcacaaagatcacgaggtcaagagattgagaccatcctggccaacatgtgaaaccccatctctattaaaaatacaaaaattagctgggcgtggtggcgtgcacctgtagtcccagctactcaggaggctgaggcaggagaatcgcttgaacctgggaggcagatgtttcagtgaactgagatcgtgccactgcactcctgcctggcgacagagcaagactctgtttaaaaaaaaaagcacggtgtggtggtgcacatctgtaactccagctacttgggaggctgaggcaggaaaatcacttgaacccaggaggcagagtttgcagtaggctgggatcgcgccactgtactccaggttgggtgagcaagactgtcttaaaaaaaaaaaaaaaaaaaggcaccgaggtgggcggatcacaaggtcaggagatcgagaccatcctggctaacatggtgaaaccccatctctactaaaaatacaaaaaattagttgggcgtggtggcacgtgcctgtagtagtcccagctactcgggaggctgaggcaggagaaacccgggaggtgaagattgcagtgagccgagatcgcgccactgcactccaggctgggcgacgaagtgagactctgtccaaaaaaaaaaaaaagaggctaggcttataggttcccctggcattattttattttttttttcatttttgccttttgaaactgagactgtctcagacagtatggaagcactattttagaaagacctaagtaggcccatactgagtgctgagaaacctgttgcgtgtttctctctctgaggacgttaactcccgttcatccatagatgaacgcagatcttctgcggtagatgtgtgcatgaattttgccaattcatttcaagtattttgggatacttggatttgaattcaatgtaagtgggtgatgatgacactgccatgtaggttcaaacagattacagaatgtttagttctggacttgcctcattacctgctaaagaagttgcccacttgtgagcatcaccaatactctgtatgatagtttgatgacattatagtgcagattttggaatggtatacttttggataaattctctcaggattatggaggaatattttgatgagcataagaatttcatctctgataggtcaaaccatattcatgttaaattattagatgaagtaatgatcctggaggaaggaatgaatagtgcttatgtggcttttttgcttatttttcagtttcaaaagaagttatatcacagaatgccaacataacctaaatgtcaaagtttcttaagttatatgctgtatttgtggcctacatggtcagtgatcaaagaaaatttataaaaatattaggaagatgggtaaattattcctttgaaaactttaattgtggtaaaatacacataaaatttaccatgttaaccacttttaagtatacagtttagtggcattaagtacattcacattgttgtggaaccagtccatctccagaactttgtcaccttgcagaactgaaactccatatccattaaacaataactctccattccccctcctccagcccctggaagccaccattctactttctatgtatttgactaccgtaggtacctctcataagtggaattagacaggatttgtccttttgtgactggcatatgtcacttagcataatgtcttcagagttcatccatgttgtagcatgtgtcagaatttcctgcctctttaaggctgaataatagtccattttatatatgtaccacattttgtttatgcattcatttgttgacggatgcttggtttgcttctaccttttggtcattgtgagtaatgctgctataaaaaacatgagtctacaaatatctttcaagtccctgctttcagttcttttggatatacccagaaatggaattgctgggtcatacggcaattctatttttaagttttcgagaaactcccatactgttttccatggcagcttcaccattttattttcccaccaacaatgcataaggattccaatttctccatatcctcaacatacttgttatgttctcttttttgtttttgtttttttgatagtagccatctaatgggtgtgaagtggtatctcattgcagtattgatccctatttccctaataattagcgatgttgagcatcttttcatgtgcttattggccattgatattttctttagagaaaatgtgtattcatgttctttgttcatttttgaattgagttttttgttgtcgagttgtaggagtaatttcttcatgatgtttacattttcaactttttactatggaaatttcaaacacatacaataataaagtagtgtaagaaattttatgtaccatcacccagcttcagcaattgtgaatgaatggccaatattatttcacttatactcaccacattattttgaaacgaatcctagaaatcatatattgataaatatttctatgtgtaacgctaaaagaaaacaaatggtatgatatttcaagaagatatcacatgaggaatatatcatgagagctctcttgtaatctgtgaggagtatggaaacaggatttgtcagtgtcgggctgtggatccataactaactgtcctttgtattgattgggctcactcttgccaagcctcatgctttgtttttgtagcagtgatagattcctgttaatctatccttgttttcttacctgatcccatgggtgaccacttgttaggcaagatttatttggcttaatcatactatctgtgtcctgaaaatagggcagtgcttcctggtttgggcagaaaccaaggcccagttgaactgctctagggaattttgctctaagctgatgccaccagtagtttaactgcacataacttcaaattgttttatcctagacattaattatatttcataattttatggtagattataaagtaaatcctaccatgagaataacttcatatttttattaagaaagaaaaaaagtctccaagagattcaagtgacatcctcagatttatttgtttttagggctttaaaataattattttggtttcttaaaatgttcttgttttacctttaagcaagtacaacagcttagaagaattatattcttttttgtttgtttgttttgagatggagtgtctttcttcttgctcaggctggaaggcaatggcgcgatctcggctcactgcaacctccgcctcccaggttcaagcgattctcctgcctcagcctcctgagtagctgggattacaggtgcccaccaccacgcccagctaattttttgtatttttcgtagagatggggtttcaccatgttggccaggctggtcttgaactcctgacctcaagtgatctgcccgcctcggtctcccaaagtgctgggattacaggtgtgagccactgcgcccggcctatattcttataataatggacaatttagataaagcaactttaatacttctgttccattcatactgaaaattggcatgatggtttatctttttttcaagtcattgttgccaataagctaggcaactggcaaacatcatgtatgaaattttttgggcttgacatactttccagtggtaattgcttctagtggttggctaggtgggggtatgagttagagtaggctctgggtatccacaggttctacattcgcagattcaaccaactgcagattgaaaataggggaaaataaccatacaataataaataatagtgcaagtaaaatatacactataacagctattttacatagcatttacattgtattaagtgttataagtaaagatgatttaaagtacatgaggtaggttatgtgtaaatactataccattttatgtcagaggcttgtgcatcctcccattttggtatctgtggggagtcctggaaccaattcccagtggatactgagggatgactgtatgatatgtcttgttaacttgaccaagagtggtagtaaagcaagtgtaacttgatatcacttagcacatcctgctgttacaataaggcttactcatgatttttctgaataacataatttatattaaatgtcctaaatactagcactgatcaagtttaagagcattcctagtgaaatattttcttattaatgcagttcccttcatatgtatatttatttatttatttccttccttccttccttccttccttctttctctctctctctctctctctttctttctttctttcaacagagtcttgctctgttccccaggctggagtgcagtggcgcaatcttggcacactgcaacccctgccttccagtttgaagccattctcctgcctcagcctctggagtagctgggactacaggtgcccgccagcaggcccggctaatttttgtatttttagtagaggtggggtttcaccatgttggccaggctagtctcgaactcctgacttcaaatgatctacccaccttggcttacagagattacaggtgtgagccaccatgcccaggctaccttcatatgtatttttcttttctcttctctcctcttcttttttatttatttatttatttatttttgagacagggtctggttctgtcacctaggctgtagtgcagtggtgagagctctgctcactgcaatctccgcctcctgggttcaagagattctcgtgcctcagcttcccaagtagctggtgttacaggtgcatgccaccacgcctggctaatttttgtatttttagtagagatggggtttcaccacgttgcccaggctggtctcgaactcctggccttaagtgatctgcccatctctgcctcccaaagtgctgggattacaggcatgagccaccgtgcccggcccatatgtataatatatttcttatccccctccccgagcaatttagcataatctttgaccatttttctgtttttgtcttttaaattagtttatctcagcaatattaattagtacttaccataatcaaaggcttgaatacaatttggaggtctatctggagactggacaatttatgaatagagatataagggtttagggagtggtgcctgtttaataatgatttcattttctttttttgctttttttttttttttgagacggagtctcactctgtcgccaggctggagtgcagtggcgaaatctcagctcactgcaacctccgcctcctgggctcaagtgattctcctgcctcagtctcctgagtagctgggactacaggcgcccgctatcacgcccagctaattttttctatttttagcagagggggtttcaccatgttggccaagatggtctcgatctcttgacctcgtgatccacccgcctccatctcccaaagtgctgggattacaggtgtgagccactgcgcctggccgatttcattttatcattcgatgcttaaatgtgatatttaaaattaagcattttgtattaaatagtaatacattcttcatgtgctagattcaaacagtaactttctaaagaaaaacttgatttccctttcctccctatctctttgcagagctgtaactgctcctcaagtttggtgtgtgttctacaggcttttttttttttttttttgagacagggcctcactctgcacccaggctggagtgcagccacatagtctcggctcactgcaaccctccatcttcaggctttcttcttaacctttccttggctttaaatgttttttaaataaatctgtactttcaaatagactttactttttggaacttttttccccctaagatgggttcctgctatgttgctacccaggctggcgtcaaactccttggctcaagcgatcattcccccactgacctcccaagtagctgggaccacaggcacacgccagcacacccagctgaaacatttttaatttttcagaaacactgagaagacagtagagagtttccatatgccctatgcccagctttccctattagcatcttatatcagtatggtacggttttcacaattattgaaccaatattagtacattgttatcaattaaagtctgtactttgttcagattttctaagtttttacctaatgtcctttttctgttccaggatcccatccaggatccaggatgatataatgtggtaatgttacatttagtcgtcctgtctccttaggctcttcttggctgtgagtttctcaaactttccttgtttttgatgagcttgacagttttgaggagtattggtcaggtctttgtagaatgtccctcaattggggtttgtttgatgtttttctcatgattagactggggctgtggatttgggggaagaccacaggtaaagtgctgttctcatcacatcatatcaagaatgcacactttcaacatgacttatcattgttgacattgaccttgatcacctggctgaggtagtgtttctcaggtttctcttctgtaaagatacgttttaccccactttccatacttactcttgggaaggaagtcactatgcatggtccacacataaggagtggggagttatgtaacacctcgctgagggccaagtattgacatgaattatttggaatttcctgcatggggcatttgtctctgctctgataatttgtttagtatttatatctgtatagactcataaatatttattttattcttccaattatccaataactgctttattttattgcttaaattgcatacctccatcattgtggatttttttttaaccacttccatactttttggcactaggctcatcttatatatttcctgcactatcctagaatcaggcatttttccaaggagcctaggttccttttattgaaaaataatactacaaaccaagatctgtgctccttgctactagggtgtcattgcttttaggccttctaagctgacagagcaaggaactatatatgtctgtatattaacctgtgggtatacacatctgtaactatttctgtatgtaccatctatctatattaagctaaacataagttcatactaatatctccacctctaatttgttaccatatgggtcactctagcctactccccttatctataaactcccactccaacatggagaaacctggctcacttccaccatccatttacatcattcttcagttctgatatacatgtgtaagttgtatcagaattattaacccacacccctgtgggaaatagtattataaccactacaggacaaagcatatgtacagttcctttgcctttagtcttaaaaactctacttatttccaaatgttacttaggtcagcaccttttcctccacccacttgagtgaggttgtttcaaacatttataatacagttatcttgttttgtcacattttgcatacatcctccagccacctaagtggatttttaaaatttgcataccttgagattctttctttgtgctatcaagttctataaattttcacaaatgcatagtgtctttttttttctttttaaacaacacgttttaagaaaaatggtaggactgatttttctttattttccaaactttctgctaatgatcatgtttgctttctttttaaagtacctttaaagaaaattttatttagaaataattttaaacttagagaaggttgcaagaatagtataacataacactcatatatctattaccaaattcatcttagacttattgttaaattttgattaacaatgaatacaatcctataaaaattgaaagcgctacagataaaacccaagtccctttaatcatcacagtcctttctctatagaattcagtgttgatttagctacttgttgtcaaattattattattattatttttgagacggagtctcgctctgttgtccaggctggagtgcagtggtgccatctcagctcactgcaatctctgcctcccgggttgaagcaattctcctgcctcagcctcccgagtagttgggattacaggcacgcaccacaatgtccagctaattcttgtatttttagtagagacggggtttcactatgttggtcaggctggtctcaaactcctgacctcaggcaatctgcccacctcagcctcccaaagtgctgggattacaggcatgagccactgcacccggcccaaactttctttctgtttataaatctcgtctacagccataccactctgaacatgcccaatctcgtctgtttataaatctcattttcacttgtacttctaccagtacctggtgccaccagttcttgagcttttgggggatacaaaacaggttgttttttggctttctggtttaggatttagctttcttgggtctgctgagtcagttaccacttgtcatcctgcttctagctttcagaaatttattgctgcttcctttcctgttgcttgtaagtttttttgcctttaaacaaacaacattttactcacatttatatttaagagggtttcaggaggaataagaggcaactgtctaatctttaattggacattatacagtaagtgtaattctttgtgtttcatttgctaaacttgcagacttagtgaggccaaaaacaccagccatgtcactgttctgtccccagaccccacatcagttgtggcctgacacatttaatgagagttgttaaattaacctagcagttgaatacttgtagaatgaaacattctgtgatgatagtgtaacaggaaaggtattaaatgcttgatgcacctactttttggctctctttgttcttgaaggaagaggggacctcatgaccaggcctgaatcaaggtggactctcctgaatagaataccttttcccacccataatgtctacctgagtatgctctactccaggctaatgagcaagcatagcttttggaacttctcactatcagagctgagcaggctgcagtcaacatgcaagcctgggttctaggcatggctctgtcactgtctttcagtgtctacatttgatttcactgtcttttcaatgtggaatattccattcttgggatatactaattggttgtttttagaagaaacaatattgtaggaattacattgtgatcaagataagttttccttcatatataatacaaactttaattgaacacctgagcacttaatgctaagtgctgtaggttgaatactaaatgttaaacatttctcatttctaaagagataaaggttggagatgcctgtttctcctttgtgtttcttttctgttatttctttctaaaattggtaactataaagccatactattcttttcatttttattgtgaaattatggatacatatgaaaggaatacatagtatagatataccttgtgcaaaataacaataataaatcagagacctgtgactgccatccaaatcatagcaatcttttttgaaagtttgtttgtttcacacgtattcttttagaccagtcagtaggagagagctgcttttgccttagttgctttgtaaggccatgtttctcctcaactcttccatgtttaaaatgcactccttgtgctgagtactgatggggataccatacctgctgttctcctctcctgaaaccatcatcactgtcctctctacagttatagcagtcatctgtgtatggctacatgcatagcctgtgaatttatttggagatttgtaaagtaatatgaatacttttcatagatgcgaactggtaagttaaaatggtattaagattagctgctatttcttcagctaagtttctgttagaaatccacctccatgcctgttttggccaacactcactaatgtatccatgctgtgccactcactggtaagtgctggggtgaacgcagtgataaaccatgcaaaggtctcagtccacagagggctcacagtctgcatcactattcctcgtacagtctttttcttctcccatttctgaattgttagtgaagtatgatttatgtataaaaacatgtacaatcacaaatgtgcagctcaatgaattttcacaaactgaacatgcacagctaactagtacttaaatccagaaacagcattgccagcactccaaaagatcccttcagtgcctttccagtcactctcctcccgggacatactcactggtatgtttagtttgcctgttctttaaaaaaatctttatatgaatctaatcatacagtaaatactgttttgagtctggcttcttttgctcaacatgatgttgcaaaatttacccatgtgggttacagtttattcatgcacactgctgtctcattatgtgaaaataccacaatttatttacctattctactgtagataggcatttgaataatttccagttttatgaatactgttgctttttccctccttatgtgtcttttggtatcatatgtaaatgtttctgttggacatataactaggagtggaattgctggatatgtgtaaattcattttttgttgatattagcaaacagttttctaaagtagttgtacaggtttatactcccatcagtagtgtagtgcgagaattctggttattatatattctcaacaacatttggtattttctgttttttattttggtcatcatctgtggttttaattttcatttctataatgactaatgaaatagagcacctttttgtaagtttattggccatttagatatctttttttgtgaaatgtctattcaagtcttgtccctttttttattgaatggcttccttattgattttaagaagttctttatatattttggatataagtccattgtctgaaaaatatatcctcccgctctttggattttcttttcactttcctaatggtgtcttctgaatgaatagtagagttctcgtgtgtgtgttttggttttgttttgtgttttaggcagagtctcgctctgttgcccaggctggagtgcagtggggtaatctcggctcactgcaacctctacctcccaggttgcagtgattctcgtgcctcagcctcccaagtagctgggactacaggggcatgccaccacacccagctaatttttctatttttagtagagatggggtttcaccatgttggccaggctggtctcaaactcctgatctcaagtgatcgtcccacctcggcctcccaaagtgctggtattacaggcatgagccactgtgcctggcccaaacaagtgatttttaaaattgttcttgaaatctaaaagaattattttttttaagaggcagggtcttgctatgttgcccaggctggtcttgaactcctgggctcaagcagtccttccacctcagcctcccaaagtgctgggattacaggtgagatccaccatgtccagccataaaataattcttgaatagatgccagttgtagtccatggtcttttgtgacttttttttctcctttggaaggagctgcttaatgtatcattttaaatgacaaataattaggagcttgtttgtgcttccatgtttctattttagagctttaacatatcttagatgaaatctatatacggggtcttgagaggttaaaacagaatgtatttaccacctttgcatttaaattatggactagattttatataaattattttaaaatgagtctgatacagccattatttttagtattgtttactctgtaaacaaaagatgaccagttcctgctattctgtcaaagtcagggagccaggtgtgtagtctccttttcaacttgtctttctctagggctttaaatccttctcaaatgggccctggagctctgagctaagcctgaattttcttatggaaccaagaagtggagaaaaagaactcacattactgaggatatggactggttataaatagtgtagatgctacttcttaatttaaaatgctatatgttcatgagcagctagacttgctattaactatttggaaatattgaacaattgtcgctccttatttccgtagtctttgtaagatcatgacccatcaaggacctaccgttaacctcaaaggctcttggctgtaggttttcctcaagctgggtgccagaaaacagaggattatttgcttgataatatcttggtggagccatcagtactagaaatatttggatgtcagacacagatcccaggggttggcaggttgatgataattttctggtgccaccccaaaaccttgcagtgctactaccataaccatggttggctaattagtgccttcggggatgagggttgatttctgctagttccttgcctttctctttggatggcatgccttcacttgttacttggacctatgtaaagaataggaagatcagaagaaaaccataaaattgatgatcataggtcacagtatttgtgctttcatttctaaggactcattctaacataaataattttctctttcaaaaccaaggtgtactcatcagttatattgatacatattaacagtgatgataaccacaaaaattttaaatagaaagctttacaaacggttagctttgtgaggggatttactgcaaaattagggtattcttttcatctgttattgtattgactttttaaaacattattctgattacttagtttttcctttggcaaattttgatttttaaatgtgttttcattttgctattgagaggattttcatttatcttttccatgggagatattgaggatagtctaactctggtaattggtttggtgggtttttcttttcttttttttggctccctatgagcaacttgaagatttttttttttttgagacggagtctcgcctctgtcgcccaggcgggagtgcagtggcgcaatctcggctcactgcaagctccacctcccgggttcacaccattctcctgcctcagcctcccaagtagctgggactacaggtgcccaccatcacgcccagctaatttttttgtatttttagtagagatggggtttcaccttgttagccaggatggtctcgatctcctaacctcgtgatctgcctgcctcggcctcccaaagtgctgggattacccacacccggcctcttgtactgtaatgtttttaaggttcatccatatttcagcatgtgtcagtatctcattttttctgggtgaataatatttcattgtacagataagccacattttgtcgatcccttcgtaagttgatgaacattgttggctattatggataatgctactgtgaagattcatgtaccagtttttgtgtgaacttgttttcagttctcttgggtatataccttggagtggaattgcttgatgttaatataaatctgtgttgctgtttttgtttgagacaggatctcactctgttgctcagactgagcaacagactagactggactcactgcagccttgaactccttggctaaagtgatcctcctgtctcagcgtcttgagtagctggatcacaggtgtgccgccatgcctggctaatttttaaatttttagtagagacaggatcttgctgtgttgcccaggctggtctcagactcctggcctcaagtgatcctcctgcctcagcctcccaaagtgctgggattgcaggctgagccactgtgttttcagcctatgtttaacttattttgaggaactgccaaacttttccacagcagctgtaccattttacattcccaccagcagtgtattagagttcccgtttctccacatactcagcacttgttattgtctgtcttttttattatagccatcctagtaagcatgaagtggtattgagtcttggttttgatttgcgttttcctgctgacttaatgatgttgagcattttgtgtctactggccttttgtatatcttctttggagaaatgtctgttcaaatcatttgcccattttataattgggttgcctttttattgtttagtctctcttatcttgtcagaattatttaaaatatcttcccctaattaataacaattagatagagaatttttcttgaatgtaaataatttggtgatgttagaataacagagtttatatttacaatatataaagtaaatgtacaggccacacaaacttaatgattatttctgaacagcagtaaaatagcatactcagctgtttaccaaaagaaatgtgcttgtttactttttgtaattatactgccttgttttggtaggatttagggactatgcagaagtagtgggttggtaatgagagctttaaaaattgcattttaaggtaaaagttttagcaattaactctaagatagaagtagtaaataacattcaaaactagagttcaagcattgacccagaattttctgatatttatttttaataacttaaagaagggacttgaaacttacaagaattttcttgctgtttaaatatgaccaaaccaagaaaaaattaagtagtgaaaatacttgcaactttatggacttactggatacttcagcattatttttcacgtgctttgtttgtttgtttgtatgaattctgaggtgtatgttgataccttttctcatatataaggatttatgggttttgtttagtgtagggttttttgttgttctctcattcttagtaaatatagataatccaagaatgacttttaagtgcctttaggtcctgccatttgctacagttataaatgttgccccttgcttagccctaatcctagccccagctctgctattgcttaaaaacaactcattttagaactgcttagtgaggagggcggtggtgaagctttcttgctgattgggaactcaaataatagtttaaatctgtagggtataatgtcttaaacgtgttaaattcaagtttgtttctattagaattagaactatatatgatttctgtgttggagattcataaaaatgtcatatttatttttaataacaataggacctagatacagaggaaggtgataaggagggaaaaaaaaacgctctattttattttatttatttatttatttttgagacagaatctcactttgtcgcccaggctgaagtgcagtggcttgatctcagcttactgtaacctccacctccccggatcaagtgattctcgtgcctaagcctcccgagtagttgggactacaggtgcatgccaccacacctggttgatttttgtatttttagtagagacgagattttaccatgttggccaggctggtctcaaactcctgacctcaagtgatccgcccacctcagcctcccaaagtgctgggattacaggtgtgacttgagaacaaaaccttagtagcacctatttgtaaataaatgttttcttaaaattgaaggtcatcaaggccaaaggcaccatggcagattgtgacatatctgaagtaggaagagttttagggttcttctggggagccattctagtctgctcagcacatagaagggagcaaaggtaatcaggaaaagagtaatggcacactctgggtgtgagaaagtgaaaggtcatctgaattctcaggtgattggattatttatttcttagcgatggaggcataggtagttataggtagttctgtattaaactctactttgtatggcctgtgtaggtaattgtatagctgtatttggaaaaaatgccatttaaatcatatttcagccgggtatggtggctcacgcctataatcccagcgctttgggaggctgaggcaggcggatcacttgaggtcaggagtttggtaccaacctggccaacatggcacaaccccatctctactaaaaatacaaaaattagccaggtatggtggtgcatgcctgtaatcccaactacttgggaggctgaggcggaagaatcacttgaacccaggaggcagaggttgcagtgagccaagatggtaccactgcactccagcctgggtgacagagtgagattctgtctcaaaaaaataaatcatatttgaagtttagtaaaattggtcagaaattatatgacaggaaaaaaaatccagtgtccaacagctatttattatctatcacagtcactcaaaggatatcccccctacccttgcccaacatctctgtgcactgagagcagaagttcccagatctgtcccagttttcagatctgtctctctgagtatcccctacaacccagattctgtgacagttaaattggactcgggcttccactgacccagttgatggaagagactgagcatctttccaactctaacccaaacgtgacaatgccgcgtattctttcagaaagtgtcaggaaagagcccgaagatccctgagctccagggacatggcagggaggctgcacagaagggttcccaggggtggaaaaggggaatcttaaaaataaattttggaaccaagtaatcaattttatagcacactctagttctagcgcacatggttcctccacttgttagtgaatgcctgacttgttgcccctgaagtgtaaaaagatgtatatttaaggattccattgttcagcaagttattatgcatgcagatggcaggcactaagtgcttactctttttgaaggtgattgcctctccccgcgatccccctacattgcagtgttttgttttaaacagctttcttgatggagcctaatcttatcaccagcattatagaaataagccagagtgagaagcctgtacagtgaggtcttgggattataccatagtcataatggtgttttaaattgtttttatttttcaattgaaaaaagtacactattctaaagtagtgaattttagtggagcaaactcttcacctggaagtgtttttttccttaccaaagtgaaaattggtggttctaagaaggctggaatttatttgcactgtcatcttttactatggtgggggatgatcaaatttaacatttccaagtttccaggagacaggcagcctatcttataaatattgtcatagaagacctcttaacctctttgttctttggatttctgtatttcttagaattgtcatgcttcctttctgagacctaaattatgcaggggtaacgtgattactttgacaccaagctcaggaaatataaaacgggttaagtataaaccaagctaggtttaaatgaagttcattactggctacagtatattaagggaacatattcgaaaagtctgtatttgcctttgttcttgctgctgactcttctgcttcttttggtgaccttcccacagcacaagagtggttaggtgtgaggaggctaagaataccttgccaagagcttcaaataatgttaaaaccagtattttaggtgaaccatggtcccaagaactctatttaagtaattcctagttcggtgtcccaggagcatttggctttactgcacctattttggccacatgtctttgtttaaaaggaaaaattatcttaggttataatacagctattttgggagtaccttaagtttaacattagattactaggattcgaaaaaatgtacccagatggtagatgctgatgagaatttgacacaagaattcatttgaaattgaagcttttgtagtattagtcagaaaaatttattgacatctggttttgaacagcatagtgagtggagattgagatgatcagttaaaatttaatggattgtggccgggcacaatggctcacgcctgtaattccagcactttgggaggctaaggcaggcatatcacctgaggtcgggagtttgagacgagcctggcccacgtctactaaaaatacaaaaattagccaggtctggtggcatacgcctgtagtcccagctacttggagtctgaggcaacagaattgcttgaacctgggaggtggaggtttcagtgagccgagatcccaccattgctctccagcctgggcaacaaaagcgaaactacatctcaaaaaaaaaaaaaaaaaaagaaagaaagaaaatttaatggattatggagctctacttcacattagtacacctcggtctctctgtttttctgtctcaattcaagatagagttctttgtagcggtatggtttagaggtggtatgtattttacaagtatgtcagttggctctgtatatcctgatgataccgaagccaggaccagacccctacgtcagttatatcactaaatattctgttattaattttcagattggctcctagtcccagccaactcatgttttaaattaatatagttcattgtcacactggactggaaaaaccaaatgaaatgtctttattctatgaagatgacttgtgtagactatacagactagcaacagcagacactttcagtgcgagttattttaaaaaattgaagatttgactggcagaaaagttgctgagatagggaaaagggatatctattgacagatatatgtagaattagggagaattttatgttttcataagtgtctcaattatttaagatttaatttggtgtgcatgtggaatataatggtaacatggtttgtctgtgatttgtcttttgtcttaacagattatttttctaactttaaaaaagtatacatcacttgaggccaggagttttaaaccagtctgggcaacacaggaagaccccatctctacaaaacataaattttaaaaaaagttagccagggtcacagtgtgccataattgtgccactgcactcctgcctggacaacaagagtgagatcctgtctctccaaaaaaaaaaaagtatgcaagtgataaatattcactacaaaatatttgaacatgcagatacacaacaaaaaggaaaaattcccctgtactcctattacctagaaataacagtgttgaactgtaaatgtctcattctaggcctcctttccattatatgtctgcctttttaaaaaggattatatgatgcctattgtttggcaagtttagcttttttcatgtaataatagtacactgtaaatatctatttgagtaatgaaatttaatttttttttttttaaagacatggtctctctcatgccccaggctggagggcagtggcacaatcttagctcgctgcagccacgacctcctgggttcaagccatcctgctgcctcagcctcctgagtagctagaaccacaggtgcatgccaccactcccgggtaatttttgtattttttgtagagacagggtttgttttgccatgttgcccaggctagtcttgaactcctaaactctcctaatctcaagcgatcccacccacctaggcctcccagagtgctaggattacaggtgtgagccaccatgcctggctgaaatttaatgtatattttttttgacacagagtttcactctgttgcccaggctggagtgcagtggcaccatctcagctcactgcaacctccgcctcccgggttaaaacgattcttgtgcctcagcctcctgagcagctgggactataggagtgtgccaccatgcctggctaatttttgtatttttagtagagattgggttttgccatgttggccaggatggcaaaatttaatttttaatggccgtttagtagtcctttgtgtgatgtactataatttatttgtctcctatgattggaatttaggttgtttctaatttttgctgacacaacacttatatgtacccattttgcctctttgaatatttccatagaataacttcctgggagtagaatacttttcttaaaggatttgtgcatttcaaggctttcaaaatacgttgccaaatagctttcgagaaaggctatttatttcagtttttgggttcttatctttctaattggctttatgcttacattaaaatatgaaatttttatttagttgcagaatgaagaagagtctggagaacctgaacaggctgcaggtgatgctcctccaccttacagcagcatttctgcagagagcgcaggtaggtaacagggcaaggtgatcacggaatccttaaaaacactctgtgctttgacattacagtttaaaaaaaaaaaagcttcagaagcagttggaagaaaggttacaaagcaagtctggattttaaataattgagaagtggatacatttaaaaatcacccccagtctcttacattcatctaagaatgtcttttggttcaattgttatgtatgtactcttaagggaatggctgggttttgtctgctagagttagtggaactccttttatttcaattcagctaatcatcaaaaaattgtgactgttaaaattctgcagcatattttgactacaaggatgagtctgggtttccaaagcccccatcttacaatgtagctacaacactgcccagttatgatgaagcggagaggaccaaggctgaagctactatccctttggttcctgggagagtgagtataatttgccatgttacttgatggctgctctgtgggaattaagttattttcattatccaattttgattcgttacttatgattgtattgattagtgaaagtagagctaattttaaaaatcaggtacatttgcttttgggataataaactcatctcttcttaaaaatgatgaggtaaattactagtcagacctgctcatttttccttcatctctcctattaccactactttttcaagtctcctgggatggctgaagtatcttgaagcagaagcacactaatgtttccttgattctgcacacttaatattttgctgttgggtggatagctgctagggaggtctaggaagagaataaatatatgcaaatttgtagaattaaactcataagagggatcttcacattgatttagatgaactccgttcttccagcagtccagatcatgtcatttgtggggacatagtgagttcagattccatctagcctgatgttgattcatggaggtggagattgggatgccatataaaccagtggagattattgggcactcttggttcttgatgtcagatatgtgagtgctgcatttgtcattttgtaaatattcatccagattgaggctgatgaaggtagggcattgtgggagaatggaagcaggataagtccccagaaatgcggggaccatcaggcctctaggctctattctagcaagtaactggagtgagtgatgagcaagtacagaagcctagtctgggcagtgtgatggcataggcccagatgttcccctcttggctttaagatagtagacagtttgcagaccacacctactgtgaggagcgaagctcctaaaatcattgcttggtagaaatagtttatgagcccaatctaggatgatcctaaatggcgatgatgtgcattcagttcttacaggtaccagggagaaactaaaaaccctagtgtctaagggcaagaccatcataatgtaactgccgtatattggaagcaaaccacatgcttggtactgtgcttgatgcttttatatattttgtatattgtttccaatcttcatagtaaccttgaaaggtagagattatattatctccattttacagatgtgaaaatttaggtccagagagaaaaagtaattttcccaaagtcatatgactgataagtagcagaagtgaaagtcaaacccagatattctagaatccaaagtccttgtttgtttcactgtactctgcagatctgttgcaatatatggtaaatagatcagtatggaaattagctctgattaatcacataactcttcagaatactttcatttgatacaagtacatatttaggaacttcttaaagggctctagtattcagcagacatgtataaagcactttttaaatataagatgcagtatattttacagtggataggtaaaaagctttgtataaggcagtgttcctcattgttattcaaaagcctaaaatccaactagggtaaagggcccacaaatactgataactaagacacataagagcagtgggcatcaagaactgaaactttttactgggtgatcataggggaaaatgagatttgatgtgggcccggagttttgatgggtaagaacattccagagggaaaaaggcacagaaagcaggtgtgaattcagccaggtgaaggcagttctgtggatgtagtaattggctttgtatgagcaagagtttgtgaagggagatagaaagtcctgactacaactgttgtttatagaatctttggaatgttagatgggcgtatttaaacttcatatgtagcttttagagaatccttcagagtttttgagcaggggtatgagaggacttgtgtggtgttttggaaacattaacttggcagcaatttctaggatgcatcatggtagaagagataccaagaggacaggaagaacagttagaaggtgttcgtaatattattagatgttacttccatatattttttggagtatatctttgaatagttatgcaaaaaacaattagcttttaattttggcaaaaccttattctgctgatacgaagtaagaatactaggtatttaatgttttaaaaaattaattataaaaattcgtttttatagaaatttcaaacaatagaggaagtatgttaagttagaaaaggaagctgccattgccaccgacttccctttctctagttcccactccccaggggaaccactgttaacaatttgggtcttccagacccttttctgtgtacaacaagttttgatattccctaaaatatttttcatttaaggagccctcattgaactgtgtacaaatctatcacttttaagtatatattcaattatttttaaatatctcaacacacacctatatcagttaaaaagatagcccacatgtgttggtattgttcatgatcatgttatttctagttttgcaatattacgttatcaagttaggatggaaaagatcttatctgctgataaggttagaagtgagatttagatctgtataccaatacaaatacatgcttatggagttgagcagtgggcagttctgtggactattcatgtatgatcgtactattcttttttcccctatatcagcctcgtaaagcacttgagctggttgattttatctttttttttttgagacggagtctcactctgttgcccaggctggagtgcagtggtgggatcttggctcactgcaagctctgcctcccgggttcatgccattctcctgccttagcctcccgagtagctgggactacaggtgcccgccaccactcccggctaatttttttgtatttttagtagagacgggtttcaccatgttagccaggatggtctcgatctcctgacctcgtgatctgcctgccttggcctcccaaagtgctgggattacaggcatgagccactgcacctggctgattttatctctaattactaatattttaggtcctaaacaggtcctcgattactgatattctagaatttaaaccaaatgtgtaagtaaattttgtcttttgtcttttcttgaggtatatttttttaaaggaagagtaaatagttctttgtgaactattcttgaagtgtattgtttttgaagtgtattaaatttttgaagtgtattgttaaagaacttgggttataagatgaaaatttcatttagaacactggggatagaagaaagatttgcttcttttctaattatatattaataatgcaaaatggaattttaaacacacattgagcctttaatgctcataattttgaactgaaccaaagcaataacttttttccttgctactcaaatttaacccttcatttttctttatgtcttccctttgcctagaaataattctttttcttttcatttaggatgaggattttgtgggtcgggatgattttgatgatgctgaccagctgaggataggaaatgatgggattttcatgttaacttttttcagtaagtatgtatgcatatcagaaccaccccctacaaactagagtgctttggattatgggtgaatctgactgaattaaaataactagttgagctaatatattaatacattatgtttatttggtgccttttactggaatattcaaagcttaatatacctttgttttaatatcccttctctttgccttctattttcatgaatatctgtggaaaatataattaaagcagttatgaggatgctgcatttttacatgagctaagcctcatcttccaggtctacggggcccttttgcgttgcttctactcatacttaatctgtagaataggaattaaatgcctttgatgaattttgctctgaaagcttcttttttctgacagatcaaagtcagcctgattttctcccttcatgttacttgccatttatctttttgtgtgcctcacatagaagtgagcaaccatttcctttatttgttgtattagaaagataagaaaatgcaatgcttttagaggtgatgttatataagttgtcaaaattcagagaacaggaggatgagtgacttgaatcagattatttgggggcacttatttaatgttgaaggcatttattttatttactggactatatatatataacacacacagtaaaaagcagaggtcaggctgggcatggtggctcatgcctataatcccagcactttgggaggccgaggcaggcagatgccctgaggtcaggagttcgagaccagcctggccaccatggtgaaaccccatctctactaaaaatacaaaaattagctgggtgtggtggcaggcacctgtaatcccagctactcaggaggctgaggcaggagaatcgattgaacccgggaggcagaggttgccgtgaggtgagatcgcaccattgcactctagcctgggggacaagagtgagacttcgtctcaaaaaaaaaaaaaaaaaaagaggtcaaaggctgggcacagtggctcatgcctgtaatcccagcactttggaaggctgaggtgggcgaatcacctggggctagaggttcaagaccaacctggccaacatggagaaaccccatctctactaaaaacaaaaattagccgttagccgggcctggcggtgcacgcctatagtcccagccactcgggaggctgaggcaggagaatcacttgaacctgggaggcagagattgcagtgagccaaggtcgtgctactgcactccagcctgggtgacagagtgagactcagtctcaaaaaaaaaaaaaaaaaaaaaagcagaggttgtaagtatacagtttggtgaatgttaaggtttgctttttgctgttttttgttttttttgctttttccttttgagacaaggtcttgctctgttgcccaggctgaatttggagtgcagtggtgtgatcacttctcagtgtacccttgacttcctgggctcaagtgatccccccacctcagcctcccaagtagctgggacttgcaggtgtgcaccactgtgcccggcttttgtttgtttgtttgtttgttttgtttttttcagtttttgtagagatgggtctcactgtggtgctcaggctggtctcaaactgctgggctcgggatcctccaacgttggcctcccaaagtgctaggattacagatgtgagctattgtgctcagcctattaaggcgtttttgaaagtgactagcagtagacataagtgtgtaaaacctgatagggaggagtttttcttgtttgctttttggggaaagacagaagaatggatgttttagaggaggtatggtgacggttgtggaggacaggctgtcttttatcctttggaaagtcatttaaacagaggcaggtgtaaggcactcttgttcttgggtaacaggacatgtctaacatctttcccctcctctgcttttgcagtggcattcctctttaactggattgggtttttcctgtctttttgcctgaccacttcagctgcaggaaggtatggggccatttcaggatttggtctctctctaattaaatggatcctgattgtcagggtaagttgtataacagaaaagatgggctctacagagaggcaataatcagaatatttttgaatattcgatttttcatttgcttttttaaaagttatttcagtgtgttaaatgatttttggtttgtctgtggtttcatgatgaagctgaaccaaaatcatttgcaaatggttcatgcacacaagttttgttgtcaaatctattgaaaactggtctatcattaatattgttcaccatctgctttgtttgtttttaatgtttataatatgataatgtatatgttctgaaattagttgtttttataataaaaggaaggatattacccctttgatatctcatcaaaagcagccattcctctcattaattctgttacagttttaatctagctctcttcttccttcttttcttttctccttctcttcccctctcccttccaggattgcttatgccaaaatgtttggggagccaaaactgtttaacaagtattgctccattaggagcctacctctcaagtaaattacagagatgtatgtctttagtgacttcagagttaccagttagttaaatttgcatgaagtaatttacagttgtaaaagatctaggcttttaaagtatcctctgatttcagataaatttattgctatcgtcaaccttataaacaaaaccaatttatccgtcataaattggcatacttaactaactaatgggtgttgcttgaccactgtagtttttctacgtagtgccaccttatttattataaaacatttgttaacgtttttagggttccagaatcctttgggaatctgatgaaagttgtaagcttttcccccacatagctaatatgtactcatctataataatggactttaggttaagaactcgagccctaaagaggttttcattccttccctaaattttaattgttactttattaacaaagaaaatactatattttacttttcgaactacattaaactcttggacaccaaagcctccaaggaaaagagaaataaaattaattccagtcttttttttttttcaaactaaattttcaactgcatttaaaaagtgaatcaaatgggccgggtgcggtggctcacgcctgtaatcccagcactttgggaggccgaggcggacagatcacgaagtcaggagatcgagaccatcctggctaacatggtgaaaccccgtctctactaaaaaaatacaaaaaaaatagccagacatggtagcgggggcctgtagtcccagctactcgggaggctgaggaaggagaatggcgtgaacccaggaggtggagcttacagtgagccgagatcgtgccactgcactccagcctgggcgacagagcgagactccttctcaaaaaaaaaaaaaaagttaaatgaattaacttgtatcaggtaggatgcttttgactgtgagtaacaaaaacctagctcaaaatggcttagaaaaaaatttttaattgtttttttaaacggggaaattttatttcccctgaaaacaagtccctgacaaggttagttaagtcagtggttctttgacatcatcaaggacagctgacatatcagcatattggcacaggtcccccctcccctcagggttaaaagatggcagtttcacgtatcagtattacattgaaacacgacagtgctcaagagaagaaaaagaactatttaaaaaaaaattttctaccacctttagaaagaactgtttttttctttgagaagcaaggaaagcttctcagaagccctcaatttccactggtcagaatggcatcctgtgcccattcctaaaccagcaagggaaggggattaccctggtatacatgataaagcttccaaagtcaagacaaggctggaggagtaggaagaaaatcaggcctcattagaaagaaggcaatggtatcatctactcaggaggctgaggtgagaggattgcttgagcccaggagttcaaatgcagcctggacaacatagtgagatcctgtctcttaaaattaataataataataattgcttttggcactgaataggcaaagtaaaacgatcattattgaaacacatttctagaagagcaaatattatgtggggaaaatgttttctaaaaaaaccaatttttgtatactttcaaaataaggagttaataaagctaaaagctgtcatatttaacaattgcttttccttgaaaggaaatagatttgcatttattgtaaccatttcaagctagtaatatgtaaaatactttcacttatattttaaaattattctaaaggctaagtgatggcattggtagaacaaataagtcttgctggtcacggtagctcacgcctgtaatcccagcactttgggaggctgatgtgggtggatcacctgaggtagggagtttgagaccggcttgaccaacatggagaaaccccatctctactaaaaatataaagttagccaggcatggtggtatatgcctgtaatcccagctactcgggaggctgaggcaggagaatcgcttgaacctgagaggcagaggttgcagtgagccgagatcacgccattgcacttcagcctgggcaacaagagcgaaactccgtctcaaaaaaaaaaaaaaaaagaataagtcttgcattttgtgattttgtgtacccttaagttaaaatgagaaattgtgtctgttaagctgctataaagtgttttgccttattttttagttttccacctatttccctggatattttgatggtcagtactggctctggtgggtgttccttgttttaggtaagtgtttttaatgtaagaaaaggcaagaaaacattacattaaattttataagtaaaattacttgtagtaaatgttcatcttgattactgtatagtaatatattaacaattaataataaacatttttaaaatgttgctttcttaaaaatagtctttcgttaccatcagagtaacatgcacgttaataaaaagtttctttgtggttgtaggttcttcctaacctatacatatattcttctcccccatgtgataaatggggtatgctgatgactctgtagtctgtcagtttttttccccttgtgagctattgccacacagcattcacagactcaaaccagaattgcttatacgcttactgcagccagttgaactaactcataagtgcaggtggcccatctttggtgggtctgtcagtagaaaacagaaaatatgtaacctcgctagacataacttctgaaagaaccaccattggatttccagaatgctttagtttaccgttggtgagaataagaactattttacaataggcaagaggacttttttttttttttttttttttttttttacagagtcttgctctgtcgcacaggctggagtgcagtggcgtgatctcggctcactgcaagctccacctcccgggttcacaccattctcctgcctcagcctcccgagtagctgggactacaggcacctgccaccacgcccggctaatttttttgtatttttagtagagacggggttttaccgtgttggccaggatggtctcgatctcctgactttgtgatccgcccgcctcggcctcccaaagtgctgggattacaggcctgagccaccatgcctggcctggattatattttttactctaaatatttatttttaaatacttttttcctagacattaaaacaaagagatgaacattggagtaaattatttcaatgttggcttcttgattatatgtaaagaaaatatatatgatacagttagagagaccaccatcacttctgtcatttctacaaaagaataacagggccatcttgtggctattaaagatggtgtgattgcctcactgtgcttctgtgacatcagtttctcctatgtcctgttttgcttcttgttgcccccttaattaagatccttggtggtggttctgctaatggttctggctaggacatcctggcacccatgcctggcaggtgtttaataaattgaggacctgggccaggcatggtggctcacgcctgtaatcccagcattttgggagactgagtcaggaggatttcaccttgaggccaggattttaagaccagcctgggcaacatagcaagacctcgtctctacaaaaaaatttttttaaattaaccaagcatggtggtttgtgcctgtagtcctagctacttgggagactgagccaggaggaccccttgagcccaggagttggagcctgcagtgaactatgatggcgtcactgcacttcagcttgggtgacagcaagacagtgtctctaaaaacaaaacaaaacagttcaggacctgttttgccaaaactgacagagccttgcattgctgaccctacattttacttagaaaacataaatcattcatcgcaccatctaccacctcctcaacagcatcatgtactctatgattggtcattagaattctaaggaaagagaaatagtaattttttttcctctattgattattgagaacttcagtaataaaaatgaccaacaggagaataatttagaagaaatagttccttggcttgcttattttctaaactgtacctttaagagaaaggctgaccacccgtgtttccccaagtcaaatcctgaatggaccaaagaggagcccttaagcgtatgttcagattgattgcttatggcataaataatttaaagaaatttaatggattgattcccttttaaagtttcatgggaggaggttttataatccttcatcattgatcattcttgctatgtaccatttgcttgtaagcaaaaaataagagtttggcccggcgtggtggctcatgcctgtaatcccagcactttgggaggccgaggcaggcagataacttgaggtcaggagttcgagaccagcatggccaccgtggtgaaaccccgtctctactaaaaatacaaaaattagctggctgtggttgctcatgcctatgatcccagctacttgggaggagaatggcttgaacccgagagacggaggttgcggtgagctgagatcgtgccactgcactccagcctgggtaacagagcaagattccatctcaaaaaaaaaaaaaaaaaaaaaaaatatatatatatatatatatatatatattaataagagtttggatacacttatgagcatttgtgcccaatattcgggtcattttgggaacttcccttttgaagagaaccagtttaatggtgttttgtcttgcagagctctgtgcagagctcccaagctggctgctcttgagctatagttagcctatagtttatttgttccacagttatttttcaagtttttttaaattagttgccaacattttaaaaatcaaaattatttcacataaaacgcctgaatgtttttacttttcttgaaagttggaatatcaagaaaagctagcctacatttcacatggcaccctttggctggagctgagttgttgctgtctcctccatacaggtcatgtgccttccagttcagtaagatcccaccaccataccccaacttagtatttgaaggggtaacccctgctcaatagtcacttgttgctttgggtcccaaacagaatgatgttccccaagctcagagctgacagctcttggttactgctaaaaatcagttcaactgtccaagtaccattttctaccactgagtatcccagtaaaagtatttaaaaaaaaaaatgtgctaaaggctcagagaccatctctgaaagaggaaggccaggaggagtatctgagtttccactggaggggcatatcacctctctgctgacagttttaggaggtacaaacttttgtgaatgtatagattctggtgtagtcacacaaaaagagtcttactaagaatagagaaataggctgggtacagtggttgacacctataatcccaactctttgggaggctgagacaggagaatcacttgagcctaggagttgaaggccagcctgagcaacatagcgagacccctatctctacagaaaattaaaaaattagctgggcatgaacctgttatcttagctacttgggaagcagaggcaggaggatcatctgggcccaggaattcaagcttgcagaggctgtgatcataccgctgcactccagcctgggcaacagagcaagaccctgtctgttaataataataataataataataataataataatagtagacaaagtttcaagttgagacgatgagaattgctgtaatagataaggggatcctgacatctagtggacaacattatatactgtcgacagaaaaaacagcccatgacaaggaaggttacattttttctttttacttgagaaaaacacagttataacctctttttgttgttgttgttgttgttgttgtttggagttcattatcttggaatgcttttttggaactcaataggtagattttgatgtttctcaatgaggctttcatatgtaaatgtttggctccatcttattttttatttcctttttagaccaattcaattctgaatgtgcaaaagacactattgactcttacattataccttctcattgaaggatggataatttggtatgaaaatcctctgcagattctggaggaaattgctaatgttttgattacctttagcagaaaaataacaatgtatcgctatcaggagagggatttctggggaggggacttaacatggaaattataaattcattcatgacttttcttttttaaattaggctttctcctgtttctcagaggatttatcaattatgcaaaagttcggaagatgccagaaactttctcaaatctccccaggaccagagttctctttatttattaaaggtattaaagaaaaaatttattctagtcccagtgtaaccatgtgctacattgtagatttctgttcagttttagagtaagtatctgtgataggggcatatagagaaagtaaagaaggcacagtccctgccttttagcagtttcttgtctagtaacagggatttttacaaaaagctattgataaagtcaaattagaaaaactgccataggagaaatcattacttcatgctttgacagtgtgaaagaggcaggggtcttagcagtcatcagaaagctgggatatttggctgcttgactgaattccagcatcctgaagccactgcttactgttgcaccagttccagaggatgacattcagaaggaacccttcaggcctaatcactcatctctgcccctaaatcccagaacctggagagactgtgtagtactttaagaactccttttgtctgggctgctgacaagcccaccaagtcttccatcttttaaaattgtcattgaggctttccccatggctttcttcaggttgacattctgataccactctaatgtgaggaaggtcaaactcaagaaaagaggagaaaggaccttttcccttgcctagaacaggaggactaagccctgccaaggctctttgattcacacatgattttccccagaggctgacactccatcttacatcaatggctgcctgaaggaagaggtagagaatcttgagaaagagtacaccagagagagctctctgtggtagcaagttctaataggctttcttggacttggctgtttgttccttggggctttggggactgtgttaatcatagagtggaaccttgagcaccacctagaggccagtccagttgaaggtcttaggcaaagcattataaaggataggtggtgtagttcagataaactttacatgatagtggagagtgtggggaagaatttcagaatcatctgaggcagagtgaagagcaaaaatagggaagtatggggcttgttcagaggatagcagcttgattggggcataaaggagtattgagggtcaaggctaaaaagtcaggttgaaacaagtttctcagataccttgagcaccaagcccatttgcagtagaaccatgaaattgatagagccagcgacatgttgggtcaatgcaagactaagcccacgtggagcacgaatttgttctgtactcgcagagtgtcagtttatataggcaatcatatactaatcgtgaggttctcaattttgaagacttgtggtggtctcaggaggtatgcttcaagaaaataaagcatctaccatagttgattttccaggtgatagaacagcattgaaagcttttaggcaacagaatcatataatgagaccctcttgaatataacaaacattttttcaagcatagtatagtaaactaaaattaacactcatggagttttccatgtgtcagataatatattaagcattttacatggataattaaatgtatgtaggtaaagaaggcttaaactgcttttaaagttagtttcattattaaaaaaactagtattcattattaaaaaacaggaatctttgattgcatgtctgaaaatgtgtagcatgtcatgaatttgaattcagtcacacagtctggacacagatggatattcataccactggcctgggccttaatgcctacaatgtgtctttgtttatgtctagaacataagagacttattagatattctttgcagttttatttagttaccattgtcatctttcatctatatatcagattggaatttatagttagccttaggtttaacttttacctatcaaggattccaaagctagtactgttgggttgctacaagtcctccttatgaagggtgctgaaatcacctaatattttccctctaatacattgacacccaagatatactgaggggacagatttctttctctttttaaaaaaagtcatcaattctgtaggtgtagtctaatgttagctctgaatttctaaatggactgagatcacacctctgtctattctctttgttcttcagttagaaagaaatctgaatctttattaggggattgcataccttcttcatcttggttctaagcataagaaatagcagcccagttgacagaaagcctgaacgtctcagttttcctgtgttgtttggtgctttactgaaaattttgttgttattgtttggattttctaaaatttctgaaatgttttttgatattctaaatttaaaactatgtatgtggggttgtgatttgaagtaggcagtccttagtaataataatgttgtaggaagtactaagggagattcaagtgttgagcctgctggtgcttcaggagtgtacgttaagagttgtcagaaactttctcagaggtaaatgaatgcacaccattggagggcataatagagtttatttgcttttctatttaactgtgataccctggtttatttgaaatcattcctgacacacccagagaattcagagctctaaattaagggtttgaggaacttacagcagaatttagaattctaatgacttcactaattttccagggatccccagagggaacctgaaaagccataatatcctatgggactgagttccctttgtccactgaaagggtaagaactctgtccagatccagatgtagaatcccttctttctctagttcagaggacatttagtttaattttgttagaagacatactagaaaaccgtcatgtgaagtaagaaagctttatttttttcctccctatcgattctttattatgcttatcacagtttttaaaaagtaattatctgctaattccaacatcaggttagataagtctatttgtattgatggatttttctcttgactctgggttacattttcctgtttttacacacctggccagttatttctttgttgcagcattgttaattatcatgttgtagagattatgagctctgaattttgtcagaaggttgttgagtttttgcctagcaggcagtcaaattactaaaggataaatttgatcttatttctaactgtcatgtacagtgattcttctagggagatagggataggggagagggaaaatgtagtttaaaaatcctaggctaactcctgctgaggaaaatcactggtaaactagtgactactctgctaaattgcctctcttgacattgtcaacctgaagccatcaaaaggatcagaatacagagtttatgcaagtagaaagctgggaatggccaatcagagaacacaaactttagaaaatggggtcagtgttcccaaaagctttattttcttttatggacttctacttctttgatggagatgtcaccaattaaaaggtagctgaagaaagacacaggtagggaatttttaaaataactttgccagaaagatacagatacagaatttttaaaataactttaccaaaacagaaaaataatatactttccatattgtactaagatttggcattttactagaaaagggcataagaatagtgacttttctagtcaggctacctgaaatatagtacaaataaaccaatcttgaagtgatcccaaaacacctccttctaatcagtcaaagtagatattacaaaagctaaacattaaagctcatgtactactatcataggggcagctctcaggttccttttcagagtccatttaagcttaagggagggaaaaatgtattaataagctgttatctgttttcctacttcataacaaaatgccagaaggaactgctaaaggtgtgcacagtggccatcaagaagtatgtgactgggccgggcgcagtggctcacgcctgtaatcccagcactttgggaggccgaggtgggcaggtcacctgaggttagaagtttgagaccagcctgggcaacatgacaaaaccccgtctctactaaagatacaaaaattatctgggtgtggtggtgtgcacctgtaatcccagctacttgggaggctgaggcagaagaatcgcttgaacccaggaggtggaggttgcagtgagccaagatcacaccactgcactccagcctgggcgacagagcgagactctgtctcaaaaaaaaaaaaaaaaaaaaaaaaaaagtatgtgactgaggaagcagaagaaacagatacctgttataaacatctgtacctgaaatggtaaaaaatgtaaagtgtttatacttttcttatttaccagttcactggaaaatacatttttatggattaccacctcctctgatgctgccaggtgaatgaggagttagctacagtaataaggtggtaacacagttgattggttatatctaacactatttgtgtggtaccaaaagcacttgtacatatgaagcataatatattttaaaattatttattttaactgcatctgaaatagaaggaaaaaaggaggtttttgagccctagcattaatgagctagggccttcataattaaaaaagtgacctagtgagctgtacctattaggcatcaaatattttaatttttttccatgtgataacagacactttcatttctccttttctgtaatttttctcctgttccttaatacttcttttattttattaaaggaaattcatctcaaggtaaaggtttacttattggactatgttataagatagcaagataatagggaaatggtgtttccagtagaatttttgctaaacaaaatttacatgtctccaagaagaactggttgtcttcctcttggaattaaatgatctgtaggctattggattcctttttttttttttttttttttacaaagtgatctgatctataatttagtaatacggtccagagtccctaagatctgtttgttcttcagtttgtgtactgccagcatttctgtaacactgccactcaagcctccaagtctcagacagcagtgccctctagcagtctttcatttggagattgtgtggtgattgagattacccactggtgacctctctaggtcctcttgagatattttattttaatttaatttttacttctcttactgaacaagcaaagggatttttaatgtttgttgggtgtcaggctttgactttgagggatctattaaagctgtttacctatgctaaagcatcataaactaaggaagtggccaggtaattgtccgtaccatattgtatattcttgcaaactctgttttgacctactagtcactgtttcatcagttttcatctattaaaagaaactgggccaggcatggtggctcacgcctgtaatcccagcactttgggaagccaaggcgggcagatcacgaggtcaggagatcaagaccatcctggctaacacagtgaaaccccgtctctactaaaaatacaaaaaatcagctgggtgtggtggcgggcgcctgtagtcccagctactcgggaggctgaggcaggagaacagcatgaacccggggggcggagcttgcagtgagccgaaattgtgccactgcactccagcctgggtgatagagcgggactccgtctcaaaaaaaaaaaaaaaaaaaatatatagaaactgataaaacaaattatttatgtttataatgagtctggcctcattgcaaaaacattcatttaatattcatctgccaattttcttttttgcttctgcttggcttttagagttcctcatatttttgtgtctctgtctctgtgctttccgaggtctttcaatctcttatgtctctcaatctaaagaaaagatgtccttgtatcagtttcagtggtttacttcaaatcacaacacaaatgaatttatagtttggaaaaatgttgataatattaaaatatgttcatttcctccagtgtgtttgtagtctctctccattttggcagccttttaaatacttacgcagtaatctaatcagaaaagatacagaagacaccgggcatagtggtgcacgcctgttagtgccagtcacttgcggggctgaggcagaaggttggcttgagccctggaggtgtaggttgcagtgagccgagctcgcgccactgcactccagcctgagtgacagactcttgtctccaaaaaaaaaaaaaagaaaagaaaagaaagaaaagacatagaagagtttcttgtggcttttatagtaatttggaggatagaaaagtaagttataggccgatatttgagcccatccaactctcacttcttgctgagtaccacaaaatagtttctcaataaatgtttattaagcagtaaatgtatctctttagtgtttcttcttttattcttaatagttcttcttttattgttaatatagggaattacttgtagtttttcccaagttattttcatgagaaccaaaacaatatactagtacagaaatgcctcaaagtattagatgaaaactgcatttagtaaaatgcgtaggcattatttcgagagcatttatttcagtcagatatattcctttcttaaaatttagtttgaaagtacatgtattattttaagagaaacatgccccaaatacaatgactttttaggaaaacttgttttttaaaagtatttgtggtacctgtgagtttatccttgttttctaattttgccatgctcggttgaggtatagcatgacatggttggcatccttactggaaagcttccttgtgcaatatctagtggaattgttagggtaaacagtatcttcaggtatattaggaaaattacttgtgcacttggattatgctctctgtcccaagtttcagtcattgctgacagcgttcagtgtgggatgcgcagtagcactgcttccattgtattcttttgttaagaggtttggaaagagagactcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 55 - DNA, 2671 bp, homo sapiens
acttccgctcgtccgcctaataccgcgcctgcgcaccgcgtctcttcctttctgggctcggacctaggtcgcggcgacatggtgagtgtgggtctctgtgcggcctagaactctatctgcctgcatctgtccttgttttcttctcccgcacccatctcctctcctgccttaccccgtgttctctcctgtctccatgcctttgcaggagacaccattgtcggaagctccccaaggcggaggggcgggggcgccttggctgggcctggcgcgctccagccgggttaacgccgggccttcggagcgcgcggccagccctgggcactggtttcgttgggttgaatttagggaaaactaggtcatatgtaattcacatgtcggtcacacgtcagtgaggtggaggaacggtgtgtggaggctccagggcctgcctgggttccaggtctatcactggtttctcccttcactctaaacaggccaaacgtaccaagaaagtcgggatcgtcggtaaatacgggacccgctatggggcctccctccggaaaatggtgaagaaaattgaaatcagccagcacgccaagtacacttgctctttctgtggcaaagtaagtaaggcaaagtctctggtgagaggagagggagggcaggtttcttacccaagtgaggcctgacttcaaggtattttataagccgtgtgctggtgggcagttggaattactcataccgttgattatgagttttaagataaaagtgttgatggtaacttcagattttgtgagacgtttttcatttaaagaaaaccgcttaaacgttaatgggtaaaataatcatttgacagagtgcccccagcctaagccaaacctgctttgtgggaaatgattccatcagttttgtctactgatgtttctgcaccaactcccaagatgtctgtgcatctaataccattctacttgttctgcgagggatttttgtttgataaaggtttgaacgtttatgtgcaaaatactgcattacagcaatccctgttttgtttttgagggagaaagggaggctttcacatccctgacaataaggtgaatccaaatttagacttctggatgcttgtaagagaaaatacttacttggttcatagtgaaaattggttctcttttatagaccaagatgaagagacgagctgtggggatctggcactgtggttcctgcatgaagacagtggctggcggtgcctggacgtacaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaa

The invention claimed is:

1. A method for the amelioration and/or treatment of cancer in an individual comprising the steps of:
   a) providing a sample of a cancer from said individual,
   b) determining the oxygen status of said cancer by:
      i) determining the transcriptional expression level of the ADM gene (SEQ ID NO: 1),
      ii) correlating said transcriptional expression level of the ADM gene to the expression level of one or more reference genes selected from the group consisting of ACTR3 (SEQ ID NO: 53), NDFIP1 (SEQ ID NO: 54), and RPL37A (SEQ ID NO: 55), and
      iii) characterizing the oxygen status of said cancer by comparing the correlated transcriptional expression level of ii) with a predetermined correlated transcriptional expression level of ADM, and
   c) if said individual has a cancer comprising a region for which the oxygen status is characterized by low oxygen level below 20 mm Hg, then administer a hypoxia-modifying agent in a therapeutically effective amount to said individual or if said individual has a cancer comprising a region for which the oxygen status is characterized by high oxygen level 20 mm Hg or higher, then subjecting said individual to radiation therapy without administering a hypoxia-modifying agent.

2. The method according to claim 1, wherein said hypoxia-modifying agent is selected from the group consisting of HBO, Carbogen, ARCON, blood transfusion, EPO, 2,3-DPG, 2,3-diphosphoglycerate, Nicotinamide, MMC, TPZ, AQ4N, PR-104, LCQ-1, RH1, indisulam, sulfonamides, sulfamates, sulfamides, oncolytic bacteria, avastin, DC101, thymidine kinase inhibitors, CA40 OXi4503, DMXAA, nimorazole, MISO and DORA.

3. The method according to claim 1, said method further comprising subjected subjecting said individual having a cancer comprising a region for which the oxygen status is characterized by low oxygen level below 20 mm Hg to radiation therapy.

4. The method according to claim 3, wherein said radiation therapy occurs as one or more fractions.

5. The method according to claim 3, wherein the hypoxia-modifying agent is administered prior to or simultaneously with said radiation therapy.

6. The method according to claim 1, wherein the method furthermore comprises a step of administering an additional compound.

7. The method according to claim 6, wherein said additional compound is anti-proliferative and/oranti-neoplastic agents.

8. The method according to claim 6, wherein said additional compound is a radiosensitizing drug.

9. The method according to claim 1, wherein said predetermined correlated transcriptional expression level in step b iii) is
   a predetermined reference sample comprising cancer cells characterized by a high oxygen level 20 mm Hg or higher and
   a predetermined reference sample comprising cancer cells characterized by a low oxygen level below 20 mm Hg.

10. The method according to claim 1, wherein said radiation therapy that is applied to said individual having a cancer comprising a region for which the oxygen status is characterized by high oxygen level 20 mm Hg or higher occurs as one or more fractions.

11. The method according to claim 1, wherein the cancer is a planocellular cancer or an adenocarcinoma.

12. The method according to claim 1, wherein said cancer is squamous cellular cancer.

13. The method according to claim 12, wherein the squamous cellular cancer is head and neck cancer.

14. The method according to claim 1, said method further comprising in step
   b) determining the oxygen status of said cancer by:
      iv) determining the transcriptional expression level of at least one additional gene selected from the group consisting of ANKRD37 (SEQ ID NO: 3), P4HA2 (SEQ ID NO: 12), NDRG1 (SEQ ID NO: 10), SLC2A (SEQ ID NO: 1), P4HA1 (SEQ ID NO: 11), LOX (SEQ ID NO: 9), C3orf28 (SEQ ID NO: 6), BNIP3L (SEQ ID NO: 5), BNIP3 (SEQ ID NO: 4), EGLN3 (SEQ ID NO: 7), PDK1 (SEQ ID NO: 13), PFKFB3 (SEQ ID NO: 14), KCTD11 (SEQ ID NO: 8), and (ALDOA (SEQ ID NO: 2),
      v) correlating said additional transcriptional expression level of the ADM gene and said at least one additional gene to the expression level of the one or more reference genes, and
      vi) characterizing the oxygen status of said cancer by comparing the correlated transcriptional expression level of v) with a predetermined correlated transcriptional expression level of ADM and said at least one additional gene.

15. The method according to claim 14, wherein the transcriptional expression level of at least ADM (SEQ ID NO: 1), ANKRD37 (SEQ ID NO: 3), P4HA2 (SEQ ID NO: 12), and NDRG1 (SEQ ID NO: 10) are determined in step iv).

16. The method according to claim 14, wherein the transcriptional expression level of at least ADM (SEQ ID NO: 1), ANKRD37 (SEQ ID NO: 3), P4HA2 (SEQ ID NO: 12), NDRG1 (SEQ ID NO: 10), SLC2A1 (SEQ ID NO: 15), P4HA1 (SEQ ID NO: 11), LOX (SEQ ID NO: 9), and C3orf28 (SEQ ID NO: 6) are determined in step iv).

* * * * *